US012698512B2

(12) United States Patent
Priceman et al.

(10) Patent No.: US 12,698,512 B2
(45) Date of Patent: Aug. 4, 2026

(54) METHODS COMPRISING ONCOLYTIC VIRUSES EXPRESSING CD19T AND BISPECIFIC T CELL ENGAGERS

(71) Applicants: City of Hope, Duarte, CA (US); Imugene Limited, Sydney (AU)

(72) Inventors: Saul J. Priceman, Valley Village, CA (US); Anthony K. Park, Pomona, CA (US); Yuman Fong, Pasadena, CA (US); Monil Shah, Sydney (AU)

(73) Assignees: City of Hope, Duarte, CA (US); Imugene Limited, Sydney (AU)

( * ) Notice: Subject to any disclaimer, the term of this patent is extended or adjusted under 35 U.S.C. 154(b) by 0 days.

(21) Appl. No.: 18/939,460

(22) Filed: Nov. 6, 2024

(65) Prior Publication Data

US 2025/0146017 A1     May 8, 2025

Related U.S. Application Data

(60) Provisional application No. 63/596,582, filed on Nov. 6, 2023.

(51) Int. Cl.
| | |
|---|---|
| *A61P 35/00* | (2006.01) |
| *A61K 35/768* | (2015.01) |
| *A61K 39/00* | (2006.01) |
| *A61K 39/395* | (2006.01) |
| *C07K 14/705* | (2006.01) |
| *C07K 16/28* | (2006.01) |
| *C07K 16/32* | (2006.01) |
| *C12N 15/86* | (2006.01) |

(52) U.S. Cl.
CPC ...... *C12N 15/86* (2013.01); *A61K 39/001112* (2018.08); *A61K 39/39541* (2013.01); *A61K 39/39558* (2013.01); *A61P 35/00* (2018.01); *C07K 14/70503* (2013.01); *C07K 16/2803* (2013.01); *C07K 16/2809* (2013.01); *A61K 2039/505* (2013.01); *A61K 2039/5256* (2013.01); *C07K 2317/31* (2013.01); *C12N 2710/24143* (2013.01); *C12N 2710/24171* (2013.01)

(58) Field of Classification Search
None
See application file for complete search history.

(56) References Cited

U.S. PATENT DOCUMENTS

| | | | |
|---|---|---|---|
| 7,446,179 B2 | 11/2008 | Jensen et al. | |
| 9,180,150 B2 | 11/2015 | Erbs et al. | |
| 12,084,687 B2 | 9/2024 | Fong et al. | |
| 2014/0302037 A1 | 10/2014 | Borges et al. | |
| 2014/0308285 A1 | 10/2014 | Yan et al. | |
| 2018/0072809 A1* | 3/2018 | Hemminki | A61P 35/02 |
| 2020/0215132 A1 | 7/2020 | Fong et al. | |

| | | | |
|---|---|---|---|
| 2021/0077554 A1 | 3/2021 | Aalipour et al. | |
| 2023/0235053 A1 | 7/2023 | Zugmaier | |
| 2025/0186520 A1* | 6/2025 | Yu | C07K 14/523 |
| 2025/0297002 A1* | 9/2025 | Xu | A61K 35/768 |
| 2025/0304690 A1* | 10/2025 | Xu | C07K 16/14 |

FOREIGN PATENT DOCUMENTS

| | | |
|---|---|---|
| CN | 101868546 | 10/2010 |
| JP | 7391831 B2 | 12/2023 |
| WO | WO 1999/054440 A1 | 10/1999 |
| WO | WO 2005/040220 A1 | 5/2005 |
| WO | WO 2008/119657 A1 | 10/2008 |
| WO | WO 2014/144722 A2 | 9/2014 |
| WO | WO 2014/151910 A1 | 9/2014 |
| WO | WO 2015/048272 A1 | 4/2015 |
| WO | WO 2016/009017 A1 | 1/2016 |
| WO | WO 2016/044811 A1 | 3/2016 |
| WO | WO 2017/046747 A1 | 3/2017 |
| WO | WO 2017/075440 A1 | 5/2017 |
| WO | WO 2017/079694 A2 | 5/2017 |
| WO | WO 2017/134140 A1 | 8/2017 |
| WO | WO 2018/031694 A1 | 2/2018 |
| WO | WO 2018/204907 A1 | 11/2018 |
| WO | WO 2019/033030 A1 | 2/2019 |
| WO | WO 2019/118918 A1 | 6/2019 |
| WO | WO 2020/072306 A1 | 4/2020 |
| WO | WO 2022/214014 A1 | 10/2022 |
| WO | WO 2023/062188 A1 | 4/2023 |
| WO | WO 2023/199235 A1 | 10/2023 |

OTHER PUBLICATIONS

Tian et al. (2021) Bispecific T cell engagers: an emerging therapy for management of hematologic malignancies. Journal of Hematology & Oncology, V. 14, Article No. 75, p. 1-18.*

Albayrak et al. (2025) T cell engagers: expanding horizons in oncology and beyond. British Journal of Cancer; doi.org/10.1038/s41416-025-03125-y; p. 1-9.*

Invitation to Pay Additional Fees and, Where Applicable, Protest Fee in International Appln. No. PCT/US2024/054812, mailed on Feb. 12, 2025, 11 pages.

Li et al., "Abstract TPS2687: Combination therapy with the oncolytic virus CD33-CD19 and blinatumomab for the treatment of advanced solid tumors," Abstract, Presented at the 2024 ASCO Annual Meeting, Chicago, IL, May 31-Jun. 4, 2024; Journal of Clinical Oncology, May 29, 2024, 42(Suppl_16): 1 page.

Li et al., "Poster 157a: Combination therapy with the oncolytic virus CD33-CD19 and blinatumomab for the treatment of advanced solid tumors," Poster, Presented at the 2024 ASCO Annual Meeting, Chicago, IL, May 31-Jun. 4, 2024, 1 page.

(Continued)

*Primary Examiner* — Ilia I Ouspenski

(74) *Attorney, Agent, or Firm* — Fish & Richardson P.C.

(57) ABSTRACT

Described herein, inter alia, are oncolytic viruses expressing a truncated human CD19 (CD19t) and methods for treating a patient suffering from a solid tumor by administering an oncolytic virus expressing truncated human CD19 (OV19t), and optionally a T cell engager targeted to CD19.

31 Claims, 272 Drawing Sheets

Specification includes a Sequence Listing.

(56) References Cited

OTHER PUBLICATIONS

Park et al., "Abstract 305: Combination Immunotherapy Using a Novel Chimeric Oncolytic Virus to Redirect CD19 Bispecific T Cell Engagers to Target Solid Tumors," Abstract, Presented at the 37th Annual Meeting of the Society for Immunotherapy of Cancer (SITC), Boston, MA, Nov. 8-12, 2022; Journal for Immunotherapy of Cancer, Nov. 7, 2022, 10(Suppl_2):A1-A1603, 1 page.

"Equillium Announces Data from Phase 1b EQUIP Study in Patients with Uncontrolled Asthma," 2022: https://www.equilliumbio.com/investors/press-releases/newsdetails/2022/Equillium-Announces-Data-from-Phase-1b-EQUIP-Study-in-Patients-withUncontrolled-Asthma/default.aspx, 4 pages.

"Equillium Announces Initiation of the Phase 3 EQUATOR Study of Itolizumab in First-line Acute Graft-Versus-Host Disease," 2022: https://www.equilliumbio.com/investors/pressreleases/news-details/2022/Equillium-Announces-Initiation-of-the-Phase-3-EQUATORStudy-of-Itolizumab-in-First-line-Acute-Graft-Versus-Host-Disease/default.aspx, 4 pages.

Aira et al., "Immunological and histological evaluation of clinical samples from psoriasis patients treated with anti-CD6 itolizumab," mAbs, May/Jun. 2014, 6(3):782-792.

Aira et al., "Immunological evaluation of rheumatoid arthritis patients treated with itolizumab," mAbs, Jan. 2016, 8(1):187-195.

Aldoss et al., "Favorable Activity and Safety Profile of Memory-Enriched CD19-Targeted Chimeric Antigen Receptor T-Cell Therapy in Adults with High-Risk Relapsed/Refractory ALL," Clin Cancer Res., Feb. 2023, 29(4):742-753.

Alho et al., "Unbalanced recovery of regulatory and effector T cells after allogeneic stem cell transplantation contributes to chronic GVHD," Blood, Feb. 2016, 127(5):646-657.

Alonso-Ramirez et al., "Rationale for Targeting CD6 as a Treatment for Autoimmune Diseases," Arthritis, 2010, 9 pages.

Andtbacka et al., "Talimogene Laherparepvec Improves Durable Response Rate in Patients With Advanced Melanoma," Journal of Clinical Oncology, Sep. 2015, 33(25):2780-2788.

Antin et al., "Cytokine Dysregulation and Acute Graft-Versus-Host Disease," Blood, Dec. 1992, 80(12): 2964-2968.

Attia et al., "Autoimmunity correlates with tumor regression in patients with metastatic melanoma treated with anti-cytotoxic T-lymphocyte antigen-4," J Clin Oneal, Aug. 2005, 23(25):6043-53.

Baan et al., "Differential effect of calcineurin inhibitors, anti-CD25 antibodies and rapamycin on the induction of FOXP3 in human T cell," Transplantation, Jul. 2005, 80(1):110-7.

Bajorath et al., "Molecular model of the N-terminal receptor-binding domain of the human CD6 ligand ALCAM," Protein Sci, 1995, 4(8):1644-1647.

Bear et al., "Replication-competent retroviruses in gene-modified T cells used in clinical trials: is it time to revise the testing requirements?" Mol Ther, Feb. 2012, 20(2): 246-249.

Beck et al., "6th Annual European Antibody Congress 2010: Nov. 29-Dec. 1, 2010, Geneva, Switzerland," mAbs, Mar./Apr. 2011, 3(2):111-132.

Bejcek et al., "Development and Characterization of Three Recombinant Single Chain Antibody Fragments (scFvs) Directed against the CD19 Antigen," Cancer Research, Jun. 1995, 55:2346-2351.

Bluestone et al., "Type 1 diabetes immunotherapy using polyclonal regulatory T cells," Sci Transl Med, 2015, 7(315): 315ra189, 34 pages.

Bonaventura et al., "Cold tumors: a therapeutic challenge for immunotherapy," Frontiers in Immunology, Feb. 2019, 10:168, 10 pages.

Boroughs et al., "Chimeric antigen receptor costimulation domains modulate human regulatory T cell function," JCI Insight, Apr. 2019, 4(8):1-19.

Brown et al., "Regression of Glioblastoma after Chimeric Antigen Receptor T-Cell Therapy," N Engl J Med, Dec. 2016, 375(26):2561-2569.

Bughani et al., "T cell activation and differentiation is modulated by a CD6 domain 1 antibody Itolizumab," PLoS one, Jul. 2017, 12(7):e0180088, 29 pages.

Cai et al., "Granzyme B is not required for regulatory T cell-mediated suppression of graft-versus-host disease," Blood, Mar. 2010, 115(9):1669-1677.

Champlin et al., "Blood stem cells compared with bone marrow as a source of hematopoietic cells for allogeneic transplantation," Blood, Jun. 2000, 95(12):3702-3709.

Chan et al., "Oncolytic Poxviruses," Annu Rev Viral., 2014, 1(1):119-141.

Charrier et al., "A lentiviral vector encoding the human Wiskott-Aldrich syndrome protein corrects immune and cytoskeletal defects in WASP knockout mice," Gene Ther, 2005, 12:597-606.

Chaurasiya et al., "A chimeric poxvirus with J2R (thymidine kinase) deletion shows safety and anti-tumor activity in lung cancer models," Cancer Gene Therapy, 2020, 27:125-135.

Chaurasiya et al., "A comprehensive preclinical study supporting clinical trial of oncolytic chimeric poxvirus CF33-hNIS-anti-PD-L1 to treat breast cancer," Molecular Therapy: Methods & Clinical Development, Mar. 2022, 24:102-116.

Chaurasiya et al., "An oncolytic poxvirus encoding hNIS, shows anti-tumor efficacy and allows tumor imaging in a liver cancer model," Mol Cancer Ther, May 2023, 22(7):882-890.

Chen et al., "A combination therapy of EGFR-CAR NK cells and oncolytic herpes simplex virus 1 for breast cancer brain metastases," Oncotarget, May 2016, 7(19):27764-27777.

Chen et al., "Driving CARs on the uneven road of antigen heterogeneity in solid tumors," Curr Opin Immunol, 2018, 51:103-110.

Chen et al., "Oncolytic vaccinia virus: a theranostic agent for cancer," Future Virology, Nov. 2010, 5(6):763-784.

Chen et al., "Using oncolytic virus to retask CD19-chimeric antigen receptor T Cells for Treatment of Pancreatic Cancer: Toward a Universal Chimeric Antigen Receptor T-Cell Strategy for Solid Tumor," Journal of the American College of Surgeons, Apr. 2024, 238(4):436-447 (Abstract Only).

Choi et al., "Endogenous Akt Activity Promotes Virus Entry and Predicts Efficacy of Novel Chimeric Orthopoxvirus in Triple-Negative Breast Cancer," Mol Ther Oncolytics, Apr. 2018, 9:22-29.

ClinicalTrials.gov [online], "A Study of AZD0486 in Subjects With Relapsed or Refractory B-Cell Non-Hodgkin Lymphoma," NCT04594642, last updated Jan. 8, 2025, retrieved on Jan. 18, 2025, URL<https://clinicaltrials.gov/study/NCT04594642?term=NCT04594642&rank=1>, 31 pages.

ClinicalTrials.gov [online], "A Study to Investigate Blinatumomab in Combination With Chemotherapy in Patients With Newly Diagnosed B-Lymphoblastic Leukemia," NCT03914625, last updated Dec. 4, 2024, retrieved on Jan. 18, 2025, URL<https://clinicaltrials.gov/study/NCT03914625?term=NCT03914625&rank=1>, 230 pages.

ClinicalTrials.gov [online], "Blinatumomab and Combination Chemotherapy or Dasatinib, Prednisone, and Blinatumomab in Treating Older Patients With Acute Lymphoblastic Leukemia," NCT02143414, last updated Dec. 27, 2024, retrieved on Jan. 18, 2025, URL<https://clinicaltrials.gov/study/NCT02143414?term=NCT02143414&rank=1>, 142 pages.

ClinicalTrials.gov [online], "Blinatumomab and Nivolumab With or Without Ipilimumab in Treating Patients With Poor-Risk Relapsed or Refractory CD19+ Precursor B-Lymphoblastic Leukemia," NCT02879695, last updated Nov. 6, 2024, retrieved on Jan. 18, 2025, URL <https://clinicaltrials.gov/study/NCT02879695?term=NCT02879695&rank=1>, 77 pages.

ClinicalTrials.gov [online], "Blinatumomab, Methotrexate, Cytarabine, and Ponatinib in Treating Patients With Philadelphia Chromosome-Positive, or BCR-ABL Positive, or Relapsed/Refractory, Acute Lymphoblastic Leukemia," NCT03263572, last updated Dec. 10, 2024 retrieved on Jan. 18, 2025, URL<https://clinicaltrials.gov/study/NCT03263572?term=NCT03263572&rank=1>, 37 pages.

ClinicalTrials.gov [online], "Ibrutinib and Blinatumomab in Treating Patients With Relapsed or Refractory B Acute Lymphoblastic Leukemia," NCT02997761, last updated May 29, 2024 retrieved on Jan. 18, 2025, URL<https://clinicaltrials.gov/study/NCT02997761?term=NCT02997761&rank=1>, 26 pages.

ClinicalTrials.gov [online], "Lenalidomide and Blinatumomab for the Treatment of Relapsed Non-Hodgkin Lymphoma," NCT02568553,

(56) References Cited

OTHER PUBLICATIONS last updated Dec. 5, 2024, retrieved on Jan. 18, 2025, URL <https://clinicaltrials.gov/study/NCT02568553?term=NCT02568553&rank=1>, 41 pages.

ClinicalTrials.gov [online], "Pembrolizumab and Blinatumomab in Treating Participants With Recurrent or Refractory Acute Lymphoblastic Leukemia," NCT03512405, last updated May 2, 2024, retrieved on Jan. 18, 2025, URL<https://clinicaltrials.gov/study/NCT03512405?term=NCT03512405&rank=1>, 32 pages.

ClinicalTrials.gov [online], "Study of A-319 in Patients With Relapsed or Refractory B-cell Lymphoma (A-319)," NCT04056975, last updated Aug. 14, 2019, retrieved on Jan. 18, 2025, URL<https://clinicaltrials.gov/study/NCT04056975?term=NCT04056975&rank=1>, 23 pages.

ClinicalTrials.gov [online], "Study to Evaluate the Safety, Tolerability, Pharmacokinetics, and Efficacy of AMG 562 in Subjects With r/r Diffuse Large B-cell Lymphoma, Mantle Cell Lymphoma, or Follicular Lymphoma," NCT03571828, last updated Mar. 22, 2024, retrieved on Jan. 18, 2025, URL<https://clinicaltrials.gov/study/NCT03571828?term=NCT03571828&rank=1>, 61 pages.

Cutler et al., "Belumosudil for chronic graft-versus-host disease after 2 or more prior lines of therapy: The ROCKstar Study," Blood, Dec. 2021, 138(22):2278-2289.

Daei Sorkhabi et al., "The current landscape of CAR T-cell therapy for solid tumors: Mechanisms, research progress, challenges, and counterstrategies," Front Immunol, Mar. 2023, 14:1113882, 25 pages.

Dander et al., "Interleukin-17-producing T-helper cells as new potential player mediating graft-versus-host disease in patients undergoing allogeneic stem-cell transplantation," Transplantation, Dec. 2009, 88(11):1261-1272.

Dogra et al., "Long-term efficacy and safety of itolizumab in patients with moderate-to-severe chronic plaque psoriasis: a double-blind, randomized-withdrawal, placebo-controlled study," J Am Acad Dermatol, 2015, 73(2):331-333.

Donello et al., "Woodchuck hepatitis virus contains a tripartite posttranscriptional regulatory element," J Virol, Jun. 1998, 72(6):5085-5092.

Donnelly et al., "Analysis of the aphthovirus 2A/2B polyprotein 'cleavage' mechanism indicates not a proteolytic reaction, but a novel translational effect: a putative ribosomal 'skip'," J Gen Virol, 2001, 82:1013-1025.

Dulan et al., "Developing and Monitoring a Standard-of-Care Chimeric Antigen Receptor (CAR) T Cell Clinical Quality and Regulatory Program," Biol Blood Marrow Transplant, 2020, 26:1386-1393.

Eapen et al., "Peripheral blood grafts from unrelated donors are associated with increased acute and chronic graft-versus-host disease without improved survival," Biol Blood Marrow Transplant, 2007, 13(12):1461-8.

Edelman et al., "The Covalent Structure of an Entire γG Immunoglobulin Molecule," Proc Natl Acad Sci USA., 1969, 63:78-85.

Enyindah-Asonye et al., "CD318 is a ligand for CD6," Proc Natl Acad Sci USA, 2017, 114(33):E6912-E6921.

Equillium Announces Positive Interim Results from the EQUALISE Study in Subjects with Lupus Nephritis. 2022: https://www.equilliumbio.com/investors/pressreleases/news-details/2022/Equillium-Announces-Positive-Interim-Results-from-theEQUALISE-Study-in-Subjects-with-Lupus-Nephritis/default.aspx, 9 pages.

Evgin et al., "Potent Oncolytic Activity of Raccoonpox Virus in the Absence of Natural Pathogenicity," Mol Ther., May 2010, 18(5):896-902.

Ferrara, "Pathogenesis of acute graft-versus-host disease: cytokines and cellular effectors," J Hematother Stem Cell Res, 2000, 9(3):299-306.

Ferreira et al., "Next-generation regulatory T cell therapy," Nature Reviews Drug Discovery, Oct. 2019, 18(10):749-769.

Fox, "The role of CD6 in autoimmune diseases," Cellular & Molecular Immunology, 2018, 15(11):1001-1002.

Garcia Santana et al., "Human treg cells are characterized by low/negative CD6 expression," Cytometry Part A, 2014, 85A: p. 901-908.

Gardner et al., "CD19CAR T Cell Products of Defined CD4:CD8 Composition and Transgene Expression Show Prolonged Persistence and Durable MRD-Negative Remission in Pediatric and Young Adult B-Cell ALL," Blood, Dec. 2016, 128(22):219, 3 pages.

Gardner et al., "Decreased Rates of Severe CRS Seen with Early Intervention Strategies for CD19 CAR-T Cell Toxicity Management," Blood, Dec. 2016, 128(22):586, 3 pages.

Garner et al., "CD6 monoclonal antibodies differ in epitope, kinetics and mechanism of action," Immunology, 2018, 155(2):273-282.

GenBank Accession No. CRL86663.1, "hypothetical protein pCPXV0072 [Cowpox virus]," dated Sep. 3, 2015, 1 page.

GenBank Accession No. DAA80683.1, "TPA_asm: hypothetical protein [Variola virus]," dated Sep. 26, 2017, 1 page.

GenBank Accession No. DAA80696.1, "TPA_asm: hypothetical protein [Variola virus]," dated Sep. 26, 2017, 1 page.

GenBank Accession No. DAD53328.1, "TPA_asm: ankyrin repeat-containing protein [Vaccinia virus]," dated Feb. 19, 2021, 1 page.

GenBank Accession No. DAD53330.1, "TPA_asm: ankyrin repeat-containing protein [Vaccinia virus]," dated Feb. 19, 2021, 1 page.

GenBank Accession No. H36855.1, "14984 Lambda-PRL2 *Arabidopsis thaliana* cDNA clone 179P20T7, mRNA sequence," dated Jan. 28, 2011, 2 pages.

GenBank Accession No. J04132.1, "Human T cell receptor zeta-chain mRNA, complete cds," dated Jan. 12, 1995, 2 pages.

GenBank Accession No. M35160.1, "Human T4 surface glycoprotein CD4 gene, complete cds," dated Jan. 24, 1994, 2 pages.

GenBank Accession No. AAB96478.1, "putative 25.1k protein [Vaccinia virus]," dated Apr. 14, 2003, 1 page.

GenBank Accession No. AAB96531.1, "EEV membrane protein [Vaccinia virus]," dated Apr. 14, 2003, 1 page.

GenBank Accession No. AAG37656.1, "CMP157.5R [Camelpox virus CMS]," dated Jul. 20, 2002, 1 page.

GenBank Accession No. AAG37700.1, "CMP191.5L [Camelpox virus CMS]," dated Jul. 20, 2002, 1 page.

GenBank Accession No. AAQ93098.1, "VACCL3_011 [Vaccinia virus]," dated Oct. 5, 2010, 1 page.

GenBank Accession No. AAQ93296.1, "VACCL3_210 [Vaccinia virus]," dated Oct. 5, 2010, 2 pages.

GenBank Accession No. AAR17846.1, "VACAC2_012 [Vaccinia virus]," dated Oct. 5, 2010, 1 page.

GenBank Accession No. AAR18037.1, "serine/threonine protein kinase-like [Vaccinia virus]," dated Oct. 5, 2010, 2 pages.

GenBank Accession No. AAR91035.1, "alpha/beta interferon receptor B19R [Vaccinia virus]," dated Jul. 18, 2007, 2 pages.

GenBank Accession No. AAS49868.1, "RPXV155 [Rabbitpox virus]," dated Oct. 21, 2005, 1 page.

GenBank Accession No. AAS49882.1, "RPXV169 [Rabbitpox virus]," dated Oct. 21, 2005, 1 page.

GenBank Accession No. AAS49884.1, "RPXV171 [Rabbitpox virus]," dated Oct. 21, 2005, 1 page.

GenBank Accession No. AAT10397.1, "chemokine-binding protein [Vaccinia virus]," dated May 15, 2004, 1 page.

GenBank Accession No. AAT10548.1, "semaphorin-like [Vaccinia virus]," dated May 15, 2004, 1 page.

GenBank Accession No. AAT10549.1, "semaphorin-like [Vaccinia virus]," dated May 15, 2004, 1 page.

GenBank Accession No. AAW23389.1, "hypothetical protein m8LTR05R [Vaccinia virus]," dated Sep. 8, 2005, 1 page.

GenBank Accession No. AAW23599.1, "hypothetical protein m8210L [Vaccinia virus]," dated Sep. 8, 2005, 1 page.

GenBank Accession No. AAW23628.1, "hypothetical protein m8239L [Vaccinia virus]," dated Sep. 8, 2005, 1 page.

GenBank Accession No. AAW23645.1, "hypothetical protein m8256L [Vaccinia virus]," dated Sep. 8, 2005, 1 page.

GenBank Accession No. AAW23902.1, "tumor necrosis factor receptor [Vaccinia virus]," dated Sep. 8, 2005, 1 page.

GenBank Accession No. AAX78481.1, "unknown [synthetic construct]," dated Apr. 11, 2005, 1 page.

GenBank Accession No. AAX78484.1, "unknown [synthetic construct]," dated Apr. 11, 2005, 2 pages.

(56)          References Cited

OTHER PUBLICATIONS

GenBank Accession No. AAX78486.1, "unknown [synthetic construct]," dated Apr. 11, 2005, 1 page.
GenBank Accession No. AAX78498.1, "unknown [synthetic construct]," dated Apr. 11, 2005, 1 page.
GenBank Accession No. AAX78507.1, "unknown [synthetic construct]," dated Apr. 11, 2005, 1 page.
GenBank Accession No. ABD52653.1, "CD47 antigen/integrin-associated protein [Vaccinia virus]," dated Jun. 12, 2007, 2 pages.
GenBank Accession No. ABD52684.1, "hypothetical protein List180 [Vaccinia virus]," dated Jun. 12, 2007, 1 page.
GenBank Accession No. ABD52693.1, "hypothetical protein List188 [Vaccinia virus]," dated Jun. 12, 2007, 1 page.
GenBank Accession No. ABG56123.1, "ankyrin-like protein [Variola virus]," dated Aug. 19, 2006, 1 page.
GenBank Accession No. ABZ79903.1, "ankyrin-like protein [synthetic Vaccinia virus]," dated May 18, 2020, 1 page.
GenBank Accession No. ABZ80122.1, "unknown [synthetic Vaccinia virus]," dated May 18, 2020, 1 page.
GenBank Accession No. ABZ80136.1, "unknown [synthetic Vaccinia virus]," dated May 18, 2020, 1 page.
GenBank Accession No. ABZ80145.1, "putative CMP170.5L-like protein [synthetic Vaccinia virus]," dated May 18, 2020, 1 page.
GenBank Accession No. ABZ80159.1, "unknown [synthetic Vaccinia virus]," dated May 18, 2020, 1 page.
GenBank Accession No. ABZ80166.1, "putative RPXV171-Rabbitpox-like protein [synthetic Vaccinia virus]," dated May 18, 2020, 1 page.
GenBank Accession No. ACA50704.1, "B5R, partial [Vaccinia virus]," dated Jul. 26, 2016, 1 page.
GenBank Accession No. ADZ29313.1, "hypothetical protein CPXV_FIN2000_MAN_197 [Cowpox virus]," dated Aug. 9, 2011, 1 page.
GenBank Accession No. AGB75726.1, "ankyrin-like protein [Vaccinia virus], " dated Jan. 9, 2013, 1 page.
GenBank Accession No. AGB75728.1, "serine protease inhibitor-like SPI-1 [Vaccinia virus]," dated Jan. 9, 2013, 1 page.
GenBank Accession No. AGB75887.1, "hydroxysteroid dehydrogenase [Vaccinia virus]," dated Jan. 9, 2013, 1 page.
GenBank Accession No. AGB75890.1, "hypothetical protein [Vaccinia virus]," dated Jan. 9, 2013, 1 page.
GenBank Accession No. AGB75892.1, "hypothetical protein [Vaccinia virus]," dated Jan. 9, 2013, 1 page.
GenBank Accession No. AGB75893.1, "ATP-dependent DNA ligase [Vaccinia virus]," dated Jan. 9, 2013, 1 page.
GenBank Accession No. AGB75894.1, "hypothetical protein [Vaccinia virus]," dated Jan. 9, 2013, 1 page.
GenBank Accession No. AGB75896.1, "secreted TNF-receptor-like protein [Vaccinia virus]," dated Jan. 9, 2013, 1 page.
GenBank Accession No. AGB75897.1, "kelch-like protein [Vaccinia virus]," dated Jan. 9, 2013, 2 pages.
GenBank Accession No. AGB75899.1, "hypothetical protein [Vaccinia virus]," dated Jan. 9, 2013, 1 page.
GenBank Accession No. AGB75900.1, "guanylate kinase [Vaccinia virus]," dated Jan. 9, 2013, 1 page.
GenBank Accession No. AGB75902.1, "hypothetical protein [Vaccinia virus]," dated Jan. 9, 2013, 1 page.
GenBank Accession No. AGB75904.1, "ankyrin-like protein [Vaccinia virus]," dated Jan. 9, 2013, 2 pages.
GenBank Accession No. AGB75913.1, "SPI-2-CrmA [Vaccinia virus]," dated Jan. 9, 2013, 1 page.
GenBank Accession No. AGB75915.1, "IL-beta-binding protein [Vaccinia virus]," dated Jan. 9, 2013, 1 page.
GenBank Accession No. AGB75917.1, "ankyrin-like protein [Vaccinia virus]," dated Jan. 9, 2013, 2 pages.
GenBank Accession No. AGB75921.1, "hypothetical protein [Vaccinia virus]," dated Jan. 9, 2013, 2 pages.
GenBank Accession No. AGB75922.1, "hypothetical protein, partial [Vaccinia virus]," dated Jan. 9, 2013, 1 page.
GenBank Accession No. AGK06629.1, "hypothetical protein VAC_TP3_165 [Vaccinia virus]," dated Apr. 27, 2013, 1 page.

GenBank Accession No. AGY98963.1, "CPXV007 protein [Cowpox virus]," dated Nov. 3, 2013, 1 page.
GenBank Accession No. AHB35818.1, "CPXV-196 [Vaccinia virus]," dated Dec. 4, 2014, 1 page.
GenBank Accession No. AIX98861.1, "C-type lectin-like type-II membrane protein [Vaccinia virus]," dated Apr. 21, 2015, 2 pages.
GenBank Accession No. AIX98921.1, "ankyrin-like protein [Vaccinia virus]," dated Apr. 21, 2015, 1 page.
GenBank Accession No. AIX98922.1, "ankyrin-like protein [Vaccinia virus]," dated Apr. 21, 2015, 2 pages.
GenBank Accession No. AIX98923.1, "hypothetical protein VAC_IHDW1_008 [Vaccinia virus]," dated Apr. 21, 2015, 1 page.
GenBank Accession No. ALF04974.1, "hypothetical protein VACV_IOC_B141_002 [Vaccinia virus]," dated Sep. 26, 2015, 1 page.
GenBank Accession No. ALF04987.1, "truncated ankyrin-like protein [Vaccinia virus]," dated Sep. 26, 2015, 1 page.
GenBank Accession No. ALF05177.1, "hypothetical protein VACV_IOC_B141_207 [Vaccinia virus]," dated Sep. 26, 2015, 1 page.
GenBank Accession No. ALF05182.1, "guanylate kinase [Vaccinia virus]," dated Sep. 26, 2015, 1 page.
GenBank Accession No. AND73828.1, "TNF-alpha-receptor-like protein [Vaccinia virus]," dated May 10, 2016, 1 page.
GenBank Accession No. AND73835.1, "hypothetical protein [Vaccinia virus]," dated May 10, 2016, 1 page.
GenBank Accession No. AND73998.1, "SUMO-1 modified protein-C-type lectin-like type-II membrane protein [Vaccinia virus], " dated May 10, 2016, 1 page.
GenBank Accession No. AU038287.1, "AU038287.1 Dictyostelium discoideum SS (H.Urushihara) Dictyostelium discoideum cDNA clone SSH520, mRNA sequence," dated May 8, 2010, 1 page.
GenBank Accession No. AU038293.1, "AU038293.1 Dictyostelium discoideum SS (H.Urushihara) Dictyostelium discoideum cDNA clone SSH526, mRNA sequence," dated May 8, 2010, 1 page.
GenBank Accession No. AU038295.1, "AU038295.1 Dictyostelium discoideum SS (H.Urushihara) Dictyostelium discoideum cDNA clone SSH528, mRNA sequence," dated May 8, 2010, 1 page.
GenBank Accession No. AU038306.1, "AU038306 Dictyostelium discoideum SS (H.Urushihara) Dictyostelium discoideum cDNA clone SSH542, mRNA sequence," dated May 8, 2010, 1 page.
GenBank Accession No. AUL80383.1, "hypothetical protein [Vaccinia virus]," dated Jan. 9, 2018, 1 page.
GenBank Accession No. AXN56046.1, "secreted chemokine-binding protein [Vaccinia virus]," dated Aug. 20, 2018, 1 page.
GenBank Accession No. NM_001561.6, "*Homo sapiens* TNF receptor superfamily member 9 (TNFRSF9), mRNA," dated Oct. 9, 2022, 6 pages.
GenBank Accession No. NM_001768.7, "*Homo sapiens* CD8a molecule (CD8A), transcript variant 1, mRNA," dated Jun. 12, 2022, 4 pages.
GenBank Accession No. NM_003327.4, "*Homo sapiens* TNF receptor superfamily member 4 (TNFRSF4), transcript variant 1, mRNA," dated Oct. 21, 2022, 5 pages.
GenBank Accession No. NM_006139.4, "*Homo sapiens* CD28 molecule (CD28), transcript variant 1, mRNA," dated Oct. 2, 2022, 6 pages.
GenBank Accession No. NM_007360.4, "*Homo sapiens* killer cell lectin like receptor K1 (KLRK1), mRNA," dated Sep. 4, 2022, 4 pages.
GenBank Accession No. NM 016382.4, "*Homo sapiens* CD244 molecule (CD244), transcript variant 1, mRNA," dated Apr. 24, 2022, 6 pages.
GenBank Accession No. QEM25152.1, "CPXV229 protein [Cowpox virus]," dated Sep. 6, 2019, 1 page.
GenBank Accession No. QGQ59895.1, "hypothetical protein PDLMKLCO_00175 [Monkeypox virus], " dated Jan. 9, 2020, 1 page.
GenBank Accession No. QGQ59915.1, "hypothetical protein PDLMKLCO_00195 [Monkeypox virus]," dated Jan. 9, 2020, 1 page.
GenBank Accession No. QMT29602.1, "hypothetical protein IKMOJFFE_00147 [Vaccinia virus]," dated Aug. 8, 2020, 1 page.
GenBank Accession No. QMT29643.1, "hypothetical protein IKMOJFFE_00188 [Vaccinia virus]," dated Aug. 8, 2020, 1 page.

(56)     References Cited

OTHER PUBLICATIONS

GenBank Accession No. SNB48636.1, "thymidylate kinase [Cowpox virus]," dated Jun. 15, 2018, 1 page.
GenBank Accession No. UIC71746.1, "ankyrin-like protein [Vaccinia virus]," dated Jan. 5, 2022, 1 page.
GenBank Accession No. UJQ44755.1, "hypothetical protein BPXVP50C5_00038 [Buffalopox virus]," dated Jan. 31, 2022, 1 page.
GenBank Accession No. UXO30862.1, "hypothetical protein VARV_ GHA68_197_212 [Variola virus]," dated Oct. 4, 2022, 1 page.
GenBank Accession No. UZL86921.1, "hypothetical protein [Vaccinia virus]," dated Nov. 14, 2022, 1 page.
GenBank Accession No. WLW36592.1, "chemokine-binding protein, partial [Monkeypox virus]," dated Aug. 23, 2023, 1 page.
GenBank Accession No. WVM33661.1, "Hydroxysteroid dehydrogenase. Partial [Monkeypox virus]," dated Feb. 11, 2024, 2 pages.
Genome.gov [online], "Genetic Discrimination," last updated Jan. 6, 2022, retrieved on Jan. 18, 2025, retrieved from URL <https://www.genome.gov/about-genomics/policy-issues/Genetic-Discrimination>, 7 pages.
GenPept Accession No. YP_010509376.1, "Copper/zinc superoxide dismutase [Horsepox virus]," dated Oct. 18, 2022, 2 pages.
GenPept Accession No. YP_010509379.1, "Thymidylate kinase [Horsepox virus]," dated Oct. 18, 2022, 2 pages.
GenPept Accession No. YP_232888.1, "ankyrin-like protein [Vaccinia virus]," dated Aug. 13, 2018, 1 page.
GenPept Accession No. YP_233051.1, "hypothetical protein VACWR169 [Vaccinia virus]," dated Aug. 13, 2018, 2 pages.
GenPept Accession No. YP_233060.1, "Toll/IL1-receptor [Vaccinia virus]," dated Aug. 13, 2018, 2 pages.
GenPept Accession No. YP_233074.1, "hypothetical protein VACWR192 [Vaccinia virus]," dated Aug. 13, 2018, 2 pages.
GenPept Accession No. YP_233083.1, "hypothetical protein VACWR201 [Vaccinia virus]," dated Aug. 13, 2018, 2 pages.
GenPept Accession No. YP_233084.1, "ankyrin-like protein [Vaccinia virus]," dated Aug. 13, 2018, 2 pages.
GenPept Accession No. YP_717506.1, "ser/thr protein kinase-like protein [Taterapox virus]," dated Dec. 20, 2020, 2 pages.
GenPept Accession No. YP_910501.1, "hypothetical protein VACWR204.5 [Vaccinia virus]," dated Aug. 13, 2018, 2 pages.
Gimferrer et al., "Relevance of CD6-mediated interactions in T cell activation and proliferation," J Immunol, 2004, 173(4):2262-70.
Gitelman et al., "Regulatory T cell therapy for type 1 diabetes: May the force be with you," J Autoimmun, 2016, 71:78-87.
Goebeler et al., "Blinatumomab: a CD19/CD3 bispecific T cell engager (BiTE) with unique anti-tumor efficacy," Leukemia & Lymphoma, May 2016, 57(5):1021-1032.
Goebeler et al., "T cell-engaging therapies—BiTEs and beyond," Nature Reviews Clinical Oncology, Jul. 2020, 17(7): 418-434.
Goldufsky et al., "Oncolytic virus therapy for cancer," Oncolytic Virotherapy, 2013, 2:31-46.
Gondek et al., "Cutting Edge: Contact-Mediated Suppression by CD4+CD25+ Regulatory Cells Involves a Granzyme B-Dependent, Perforin-independent Mechanism," J Immunol, 2005, 174(4):1783-1786.
Goulmy et al., "Mismatches of minor histocompatibility antigens between HLA-identical donors and recipients and the development of graft-versus-host disease after bone marrow transplantation," N Engl J Med, Feb. 1996, 334(5):281-285.
Gubser et al., "Poxvirus genomes: a phylogenetic analysis," J Gen Virol., Jan. 2004, 85(Pt 1):105-117.
Guo et al., "Regulatory T Cells in GVHD Therapy," Front Immunol, Jun. 2021, 12:1-12.
Hamieh et al., "Programming CAR T Cell Tumor Recognition: Tuned Antigen Sensing and Logic Gating," Cancer Discov, 2023, 13(4):829-843.
Hammad et al., "Neural Stem Cells Improve the Delivery of Oncolytic Chimeric Orthopoxvirus in a Metastatic Ovarian Cancer Model," Molecular Therapy Oncolytics, Sep. 2020, 18:326-334.

Harris et al., "Plasma biomarkers of lower gastrointestinal and liver acute GVHD," Blood, 2012, 119(12):2960-3.
Hassan et al., "Frontline: Optimal T cell activation requires the engagement of CD6 and CD166," Eur J Immunol, 2004, 34(4): 930-940.
Hernandez et al., "Therapeutic Targeting of CD 6 in Autoimmune Diseases: A Review of Cuban Clinical Studies with the Antibodies IOR-T1 and Itolizumab," Curr Drug Targets, 2016, 17(6):666-677.
Huehls et al., "Bispecific T-cell engagers for cancer immunotherapy," Immunol Cell Biol, 2015, 93(3):290-6.
International Preliminary Report on Patentability in International Application No. PCT/US2018/046313, dated Feb. 11, 2020, 8 pages.
International Search Report in International Application No. PCT/US2018/046313, dated Nov. 20, 2018, 15 pages.
Jagasia et al., "National Institutes of Health Consensus Development Project on Criteria for Clinical Trials in Chronic Graft-versus-Host Disease: I. The 2014 Diagnosis and Staging Working Group report," Biol Blood Marrow Transplant, 2015, 21 (3):389-401.e1.
Jonnalagadda et al., "Chimeric antigen receptors with mutated IgG4 Fc spacer avoid Fc receptor binding and improve T cell persistence and antitumor efficacy," Mol Ther, 2015, 23(4):757-768.
Kantarjian et al., "Blinatumomab versus Chemotherapy for Advanced Acute Lymphoblastic Leukemia," N Engl J Med, 2017, 376(9):836-847.
Kaufman et al., "Oncolytic viruses: a new class of immunotherapy drugs," Nat Rev Drug Discov, Sep. 2015, 14(9):642-62.
Kim et al., "Recombinant Orthopoxvirus Primes Colon Cancer for Checkpoint Inhibitor and Cross-Primes T Cells for Antitumor and Antiviral Immunity," Mol Cancer Ther, 2021, 20(1):173-182.
Kleijwegt et al., "Transfer of regulatory properties from tolerogenic to proinflammatory dendritic cells via induced autoreactive regulatory T cells," J.Immunol., 2011, 187(12):6357-6364.
Koreth et al., "Itolizumab, a Novel Targeted Anti-CD6 Therapy, in Combination with Corticosteroids, is Well-Tolerated, with Rapid Pharmacodynamic and Clinical Response in Newly Diagnosed Acute Graft-Versus-Host Disease," Blood, 2021, 138(Supplement 1):2891-2891.
Kowolik et al., "Locus control region of the human CD2 gene in a lentivirus vector confers position-independent transgene expression," J Virol, 2001, 75(10):4641-8.
Kretschmann et al., "Successful generation of CD19 chimeric antigen receptor T cells from patients with advanced Systemic Lupus Erythematosus," Transplant Cell Ther, 2022, 29:27-33.
Krupashankar et al., "Efficacy and safety of itolizumab, a novel anti-CD6 monoclonal antibody, in patients with moderate to severe chronic plaque psoriasis: results of a double-blind, randomized, placebo-controlled, phase-III study," J Am Acad Dermatol, 2014, 71(3):484-492.
Lee et al., "ASTCT Consensus Grading for Cytokine Release Syndrome and Neurologic Toxicity Associated with Immune Effector Cells," Biol Blood Marrow Transplant, 2019, 25(4):625-638.
Lee et al., "High-resolution donor-recipient HLA matching contributes to the success of unrelated donor marrow transplantation," Blood, 2007, 110(13):4576-83.
Li et al., "Attenuation of Murine Collagen-Induced Arthritis by Targeting CD6," Arthritis Rheumatol, 2020, 72(9):1505-1513.
Liu et al., "Oncolytic herpes simplex virus delivery of dual CAR targets of CD19 and BCMA as well as immunomodulators to enhance therapeutic efficacy in solid tumors combined with CAR T cell therapy," Frontiers in Oncology, Oct. 2022, 13 pages.
MacDonald et al., "Alloantigen-specific regulatory T cells generated with a chimeric antigen receptor," J Clin Inv, Apr. 2016, 126(4):1413-1424.
Magnani et al., "Killing of myeloid APCs via HLA class I, CO2 and CD226 defines a novel mechanism of suppression by human Tr1 cells," Eur J Immunol, 2011, 41(6):1652-1662.
Maker et al., "Tumor regression and autoimmunity in patients treated with cytotoxic T lymphocyte-associated antigen 4 blockade and interleukin 2: a phase III/ study," Ann Surg Oneal, 2005, 12(12):1005-1016.

(56)                    References Cited

OTHER PUBLICATIONS

Marek-Trzonkowska et al., "Administration of CD4+CD25highCD127-regulatory T cells preserves beta-cell function in type 1 diabetes in children," Diabetes Care, 2012, 35(9):1817-1820.

Marek-Trzonkowska et al., "Therapy of type 1 diabetes with CD4(+)CD25(high)CD127-regulatory T cells prolongs survival of pancreatic islets—results of one year follow-up," Clin Immunol, 2014, 153(1):23-30.

Martin et al., "A retropsective analysis of therapy for acute graft-versus-host disease: secondary treatment," Blood, 1991, 77(8):1821-1828.

Menon et al., "Itolizumab—a humanized anti-CD6 monoclonal antibody with a better side effects profile for the treatment of psoriasis," Clin Cosmet Investig Dermatol, 2015, 8:215-22.

Miklos et al., "Ibrutinib for chronic graft-versus-host disease after failure of prior therapy," Blood, 2017, 130(21):2243-2250.

Miyoshi et al., "Development of a self-inactivating lentivirus vector," J Virol, Oct. 1998, 72(10):8150-8157.

Moreau et al., "Teclistamab in Relapsed or Refractory Multiple Myeloma," N Engl J Med, Aug. 2022, 387(6):495-505.

Murad et al., "Pre-conditioning modifies the TME to enhance solid tumor CAR T cell efficacy and endogenous protective immunity," Mol Ther, 2021, 29(7):2335-2349.

Nair et al., "CD6 synergistic co-stimulation promoting proinflammatory response is modulated without interfering with the activated leucocyte cell adhesion molecule interaction," Clinical and experimental immunology, 2010, 162(1):116-130.

Nelson, "IL-2, Regulatory T Cells, and Tolerance," J Immunol, 2004, 172(7):3983-3988.

Nie et al., "Biology drives the discovery of biospecific antibodies as innovative therapeutics," Antibody Therapeutics, 3(1):18-62.

Nishio et al., "Oncolytic virus expressing RANTES and IL-15 enhances function of CAR-modified T cells in solid tumors," Oncoimmunology, Feb. 2015, 4(2):e988098, 3 pages.

O'Leary et al., "A Novel Oncolytic Chimeric Orthopoxvirus causes regression of pancreatic cancer xenografts and exhibits abscopal effect at a single low dose," J Transl Med, 2018, 16:110, 11 pages.

O'Leary et al., "A Novel Oncolytic Chimeric Orthopoxvirus Encoding Luciferase Enables Real-Time View of Colorectal Cancer Cell Infection," Molecular Therapy Oncoloytics, Jun. 2018, 9:13-21.

Paczesny et al., "Elafin is a biomarker of graft-versus-host disease of the skin," Sci Transl Med, 2010, 2(13):13ra2, 19 pages.

Papathanasiou et al., "Autologous CART-cell therapies supply chain: challenges and opportunities?" Cancer Gene Ther, 2020, 27(10-11):799-809.

Parato et al., The oncolytic poxvirus JX-594 selectively replicates in and destroys cancer cells driven by genetic pathways commonly activated in cancers, Mol Ther, 2012, 20(4):749-758.

Park et al., "CD19-targeted CAR T-cell therapeutics for hematologic malignancies: interpreting clinical outcomes to date," Blood, 2016, 127(26):3312-3320.

Park et al., "Combination Immunotherapy Using a Novel Chimeric Oncolytic Virus (Oncarlytics) to Redirect CD19 Bispecific T-Cell Engagers to Target Solid Tumors," Poster, Presented at the 37th Annual Meeting of the Society for Immunotherapy of Cancer (SITC), Boston, MA, Nov. 8-12, 2022, 1 page.

Park et al., "Effective combination immunotherapy using oncolytic viruses to deliver CAR targets to solid tumors," Science Translational Medicine, Sep. 2020, 12(559):eaaz1863, 14 pages.

Parolin et al., "Analysis in human immunodeficiency virus type 1 vectors of cis-acting sequences that affect gene transfer into human lymphocytes," J Virol, 1994, 68(6):3888-3895.

PIR Accession No. JQ1823, "SalFb protein—vaccinia virus (strain WR)," dated May 7, 1999, 1 page.

Poh, "First Oncolytic Viral Therapy for Melanoma," Cancer Discovery, Jan. 2016, 6(1):6.

Priceman et al., "Co-stimulatory signaling determines tumor antigen sensitivity and persistence of CAR T cells targeting PSCA+ metastatic prostate cancer," Oncoimmunology, 2018, 7(2):e1380764, 13 pages.

Priceman et al., "Regional Delivery of Chimeric Antigen Receptor-Engineered T Cells Effectively Targets HER2( +) Breast Cancer Metastasis to the Brain," Clin Cancer Res, 2018, 24(1):95-105.

Priceman et al., "Smart CARs Engineered for Cancer Immunotherapy," Current Opinion in Oncology, Nov. 2015, 27(6):466-474.

Qin et al., "Genome scale patterns of recombination between coinfecting vaccinia viruses," Journal of Virology, May 2014, 88(10):5277-5286.

Raffin et al., "Treg cell-based therapies: challenges and perspectives," Nature Reviews Immunology, 2020, 20(3):158-172.

Rambaldi et al., Phenotypic and functional characterization of the CD6-ALCAM T cell costimulatory pathway after allogeneic cell transplantation, Haematologica, Nov. 2022, 107:2617-2629.

Rasmussen et al., "Isolation and characterization of CD6-T cells from peripheral blood," J Immunol, 1994, 152(2):527-36.

Ribas et al., "Oncolytic Virotherapy Promotes Intratumoral T Cell Infiltration and Improves Anti-PD-I Immunotherapy," Cell, Sep. 2017, 170(6):1109-1119.

Rieger et al., "Mucosal FOXP3+ regulatory T cells are numerically deficient in acute and chronic GvHD," Blood, 2006, 107(4):1717-23.

Ringden et al., "The graft-versus-leukemia effect using matched unrelated donors is not superior to HLA-identical siblings for hematopoietic stem cell transplantation," Blood, Mar. 2009, 113(13):3110-8.

Rintoul et al., "ORFV: a novel oncolytic and immune stimulating parapoxvirus therapeutic," Mol Ther., 2012, 20(6):1148-1157.

Rodriguez et al., "A clinical exploratory study with itolizumab, an anti-CD6 monoclonal antibody, in patients with rheumatoid arthritis," Results in immunology, 2012, 2:204-211.

Rodriguez et al., "The anti-CD6 antibody itolizumab provides clinical benefit without lymphopenia in rheumatoid arthritis patients: results from a 6-month, open-label Phase I clinical trial," Clin Exp Immunol, 2018, 191(2):229-239.

Roque-Navarro et al., "Humanization of predicted T-cell epitopes reduces the immunogenicity of chimeric antibodies: new evidence supporting a simple method," Hybrid Hybridomics, 2003, 22(4):245-57.

Rozmus et al., "Early and late extensive chronic graft-versus-host disease in children is characterized by different Th1/Th2 cytokine profiles: findings of the Children's Oncology Group Study ASCT0031," Biol Blood Marrow Transplant, 2011, 17(12):1804-13.

Russell et al., "Oncolytic virotherapy," Nat Biotechnol., Jul. 10, 2012, 30(7):658-670.

Sanchez-Sampedro et al., "The evolution of poxvirus vaccines," Viruses, 2015, 7:1726-1803.

Sangamo Therapeutics Reports Recent Business Highlights and Second Quarter 2022 Financial Results. 2022: https://investor.sangamo.com/news-releases/news-releasedetails/sangamo-therapeutics-reports-recent-business-highlights-and-3.

Sarantopoulos et al., "High levels of B-ce/1 activating factor in patients with active chronic graft-versus-host disease," Clin Cancer Res, Oct. 2007, 13(20):6107-14.

Schreeb et al., "Study Design: Human Leukocyte Antigen Class I Molecule A* 02-Chimeric Antigen Receptor Regulatory T Cells in Renal Transplantation," Kidney Int Rep, 2022, 7(6):1258-1267.

Schutsky et al., "Rigorous optimization and validation of potent RNA CAR T cell therapy for the treatment of common epithelial cancers expressing folate receptor," Oncotarget, Sep. 2015, 6(30):28911-28928.

Shaw et al., "The importance of HLA-DPB1 in unrelated donor hematopoietic cell transplantation," Blood, 2007, 110(13):4560-4566.

Soiffer et al., "CD6+ T cell depleted allogeneic bone marrow transplantation from genotypically HLA nonidentical related donors," Biology of Blood and Marrow Transplantation: Journal of the American Society for Blood and Marrow Transplantation, Apr. 1997, 3(1):11-17 (Abstract Only).

Soiffer et al., "Prediction of graft-versus-host disease by phenotypic analysis of early immune reconstitution after CD6-depleted allogeneic bone marrow transplantation," Blood, Oct. 1993, 82(7):2216-23.

(56)          References Cited

OTHER PUBLICATIONS

Soiffer et al., "CD6+ T cell-depleted allogeneic bone marrow transplantation for non-Hodgkin's lymphoma," Bone Marrow Transplant, 1998, 21(12):1177-81.

Spellman et al., "The detection of donor-directed, HLA-specific alloantibodies in recipients of unrelated hematopoietic cell transplantation is predictive of graft failure," Blood, Apr. 2010, 115(13):2704-2708.

Srivastava, "Itolizumab in Psoriasis," Indian J Dermatol, 2017, 62(4):418-421.

Sterner et al., "CAR-T cell therapy: current limitations and potential strategies," Blood Cancer J, 2021, 11(4):69, 11 pages.

Swart, "Activated leukocyte cell adhesion molecule (CD166/ALCAM): developmental and mechanistic aspects of cell clustering and cell migration," Eur J Cell Biol, Jun. 2002, 81(6):313-21.

Tang et al., "In vitro-expanded antigen-specific regulatory T cells suppress autoimmune diabetes," J Exp Med, 2004, 199(11):1455-65.

Tarbell et al., "CD25+ CD4+ T cells, expanded with dendritic cells presenting a single autoantigenic peptide, suppress autoimmune diabetes," J Exp Med, Jun. 2004, 199(11):1467-1477.

Tenspolde et al., "Regulatory T cells engineered with a novel insulin-specific chimeric antigen receptor as a candidate immunotherapy for type 1 diabetes," J Autoimmun, 2019, 103:102289, 10 pages.

Thorne et al., "Rational strain selection and engineering creates a broad-spectrum, systemically effective oncolytic poxvirus, JX-963," J Clin Invest., 2007, 7(11):3350-3358.

Tree et al., "Naturally arising human CD4 T-cells that recognize islet autoantigens and secrete interleukin-10 regulate proinflammatory T-cell responses via linked suppression," Diabetes, 2010, 59(6):1451-1460.

UniProt Accession No. P08714.1, "RecName: Full-Protein OPG185; AltName: Full-Hemagglutinin; Flags: Precursor," dated Jun. 2, 2021, 3 pages.

UniProt Accession No. P15391, "RecName: Full=B-lymphocyte antigen CD19; AltName: Full-B lymphocyte surface antigen B4; AltName: Full-Differentiation antigen CD19; AltName: Full=T-cell surface antigen Leu-12; AltName: CD antigen-CD19; Flags: Precursor," dated Oct. 12, 2022, 12 pages.

UniProt Accession No. P20523.1, "RecName: Full=Uncharacterized 7.9 kDa protein," dated Sep. 29, 2021, 1 page.

UniProt Accession No. P20524.1, "RecName: Full=Uncharacterized 9.5 kDa protein," dated Sep. 29, 2021, 1 page.

UniProt Accession No. P20527.1, "RecName: Full=Uncharacterized 8.5 kDa protein," dated Oct. 12, 2022, 1 page.

UniProt Accession No. P20530.1, "RecName: Full=Uncharacterized 8.8 kDa protein," dated Sep. 29, 2021, 1 page.

UniProt Accession No. P20543.1, "RecName: Full=Uncharacterized 10.8 kDa protein," dated Sep. 29, 2021, 1 page.

UniProt Accession No. P20549.1, "RecName: Full=Uncharacterized 7.6 kDa protein" Aug. 12, 2020, 1 page.

UniProt Accession No. P21000.1, "RecName: Full=Schlafen-like protein; AltName: Full=Protein B3," dated Feb. 23, 2022, 2 pages.

UniProt Accession No. P21005.1, "RecName: Full=Protein B9; Flags: Precursor," dated Sep. 29, 2021, 2 pages.

UniProt Accession No. P21065.1, "RecName: Full=Protein A43; Flags: Precusor," dated Sep. 29, 2021, 2 pages.

UniProt Accession No. P21099.1, "RecName: Full=Protein C15/B21," dated Sep. 29, 2021, 2 pages.

UniProt Accession No. P68472.1, "RecName: Full=Uncharacterized 11.8 kDa protein," dated Aug. 12, 2020, 1 page.

UniProt Accession No. P68474.1, "RecName: Full=Uncharacterized 7.8 kDa protein," dated Aug. 17, 2020, 1 page.

UniProt Accession No. P68476.1, "RecName: Full=Uncharacterized 10.5 kDa protein," dated Feb. 23, 2022, 1 page.

UniProt Accession No. P68628.1, "RecName: Full=Uncharacterized 7.5 kDa protein," dated Sep. 29, 2021, 2 pages.

Voynov et al., "Discovery Strategies to Maximize the Clinical Potential of T-Cell Engaging Antibodies for the Treatment of Solid Tumors," Antibodies (Basel), 2020, 9(4):65, 17 pages.

Walker, "Treg and CTLA-4: two intertwining pathways to immune tolerance," J Autoimmun, 2013, 45:49-57.

Wang et al., "Phase 1 studies of central memory-derived CD19 CART-cell therapy following autologous HSCT in patients with B-cell NHL," Blood, 2016, 127(24):2980-90.

Wang et al., "Phenotypic and Functional Attributes of Lentivirus Modified CD19-specific Human CD8+ Central Memory T Cells Manufactured at Clinical Scale," J Immunotherapy, Nov. 2012, 35(9):689-701.

Warburton et al., "Inverted Repeat Structure of the Human Genome: The X-Chromosome Contains a Preponderance of Large, Highly Homologous Inverted Repeats That Contain Testes Genes," Genome Research, 2024, 14:1861-1869.

Warner et al., "A Novel Chimeric Poxvirus Encoding hNIS is Tumor-Tropic, Imageable, and Synergistic with Radioiodine to Sustain Colon Cancer Regression," Molecular Therapy Oncolytics, Jun. 2019, 13:82-92.

Weisdorf et al., "Treatment of moderate/severe acute-graft-versus-host disease after allogeneic bone marrow transplantation: an analysis of clinical risk features and otucome," Blood, 1990, 75(4):1024-1030.

Whangbo et al., "A phase 1 study of donor regulatory T-ce/1 infusion plus low-dose interteukin-2 for steroid-refractory chronic graft-vs-host disease," Blood Adv, Nov. 2022, 6(21):5786-5796.

Woolfrey et al., "HLA-C antigen mismatch is associated with worse outcome in unrelated donor peripheral blood stem cell transplantation," Biol Blood Marrow Transplant, 2011, 17(6):885-92.

Yam et al., "Design of HIV vectors for efficient gene delivery into human hematopoietic cells," Mol Ther, Apr. 2002, 5(4):479-84.

Yang et al., "Development of the oncolytic virus, CF33, and its derivatives for peritoneal-directed treatment of gastric cancer peritoneal metastases," J Immunother Cancer, 2023, 11:e006280, 14 pages.

Yong et al., "Research progress on improving the anti-cancer activity and safety of CAR-T cells therapy," Journal of Pharmaceutical Practice, Jul. 25, 2016, 34(4):372-376 (English Abstract).

Young et al., "Next-Generation CAR T-cell Therapies," Cancer Discov, 2022, 12(7):1625-1633.

Yu et al., "Clinical trials with oncolytic adenovirus in China," Curr Cancer Drug Targets., 2007, 7(2):659-670.

Zeiser et al., "Ruxolitinib for Gluococorticoid-Refractory Chronic Graft-versus-Host Disease," NEJM, Jul. 2021, 385(3):228-238.

Zhang et al., "Risks and Solutions to Chimeric Antigen Receptor-Engineered T Cell-based Cancer Immunotherapy," Acta Pharmaceutica Sinica, Jul. 1, 2016, 51(7):1032-1038 (Abstract Only).

Zheng et al., "Acquisition of suppressive function by activated human CD4+ CD25− T cells is associated with the expression of CTLA-4 not FoxP3," J Immunol, 2008, 181(3):1683-91.

Zimmerman et al., "Long-term engagement of CD6 and ALCAM is essential for Teel/proliferation induced by dendritic cells," Blood, 2006, 107(8):3212-20.

Zorn et al., "Reduced frequency of FOXP3+ CD4+ CD25+ regulatory T cells in patients with chronic graft-versus-host disease," Blood, Oct. 2005, 106(8):2903-11.

International Search Report and Written Opinion in International Appln. No. PCT/US2024/054812, mailed on Apr. 2, 2025, 19 pages.

* cited by examiner

CD19-TCE          PBMC

CF33-hCD19t (OV19t): total bp: 182474 bp
Transgene (hCD19t) is underlined and identified (FIG. 11Y)
Promoter (pSE): is underlined and identified (FIG. 11Y)

5'TTCCACGGAAGAACTACCAACAGTTACTCCAATTACAACAACATATGAACCTTCTACATATAATTATACTAT
CGATGATAGCACTGTTATTACTACTGAAGAACTACAAGTGACTCCTCATATGGATCTCCATCGATGATACATG
TATTAAAATACTTTCCGAATAAGTCTTTTAAATATTGTATTAATTATGAAAAACTATGCTATGCGAGTATGATGC
AAAGATGTTTAATGATACGATACTAGATTTTATCTCTAGCGAGAGATGTCGTTAGAATCATTTATCATAACTAC
GTTTAATAATAATTCATCAACGAATATCGATAACATGTGTCATTTATACGTTAAAGTCTGTCCGTCTTCTCTATT
GTTTAGACTGTTTGTAGAATGCTGTGATATAAACAAACTAGTAGAAGGTACGACTCCGTTACACTGTTATCTA
ATGAATGAAGGATTTGAATCATCTGTTTTAAAAAACCTATTAAAGGAGTATGTCATGAATACGTTTAATGTTC
ATGACATCCATTACACAAATATTTAACTCATGATGAAGTTGAGAATGATATGCTTTCTGATAGTATAGATAGCT
TTAGCTAATATAAAAATATATTAATCCACTATATATTCTAGACTTGATTTAAAACCGATAAACTACTACTACGTA
CTGTATAAGTTGTTAAAAAAAGGAGCAGACCCTAATTATGTAGATGATAGAGGTAATACTTTTCTTCATTACT
TCTGCATCTATATGTCCACTTATGAGAAAACGTCATTTAATAAGATGCATCGTGAAAAGAAATTTATTAAAGA
GTTGGTAAAATATGAAACCGAAAGTAAATAATATAGGAAATACACCTCTACATAACTACGTATCTCAATATGA
TATCACTCTCATTCCTCATCCACAACCCATTAAAAAAAATGGAAATTAAAGCCCTCTATTAGCATAAACGGCTA
CAGGTCTACCTTTACAATGGCCTCTCCTTGTGCCCAGTTCAGACCCTGTCATTGCCACGCTACTAAGGACTC
CCTGAATACCGTGGCCGACGTCAGACATTGTCTGACTGAATACATCCTGTGGGTTTCTCATAGATGGACCCA
TAGAGAAAGCGCAGGGTCTCTCTACAGGCTTCTCATCTCTTTCAGAACTGATGCAACGGAGCTCTTTGGTG
GTGAGTTGAAGGATTCACTTCCGTGGGACAATATCGACAATTGCGTGGAGATCATTAAATGTTTCATCAGA
AATGACTCCATGAAAACCGCCGAAGAACTTCGTGCAATCATTGGACTTTGTACTCAATCAGCTATCGTCTCT
GGAAGAGTCTTCAACGATAAGTATATCGACATACTACTTATGCTGCGAAAGATTCTGAACGAGAACGACTAT
CTCACCCTCTTGGATCATATCCGCACTGCTAAATACTAAATCTCCTTCATGCTCTCTCACTACACTTTTTATCAT
CTTATGAGGAATGATTGCCTTCATCATTTTTCGTGAAATAGGAATAATTAGCACCAGAATAGCTATGGATTGC
ACATGTATTCTATGTCGTCTACTGGATGAAGATGTGACGTACAAAAAAATAAAACTAGAAATTGAAACGTGT
CACAACTTATCAAAACATATAGATAGACGAGGAAACAATGCGCTACATTGTTACGTCTTCAATAAATGCGAT
ACAGACATTAAGATTGTTCGACTGTTACTCTCTCGCGGAGTCGAGAGACTTTGTAGAAACAACGAAGGATT
AACTCCGCTAGGAGCATACAGTAAGCATAGATACGTAAAATCTCAAATTGTGCATCTACTGATATCCAGCTAT
TCGAATTCCTCTAACGAACTCAAGTCGAATATAAATGATTTCGATCTGTATTCGTATATGTCTTCGGATAATATC
GACTTACGTCTGCTAAAATACCTAATTGTGGATAAACGGATACGTCCGTCCAAGAATACGAATTATGCAATC
AATGGTCTCGGATTGGTGGATATATACGTAACGACGCCTAATCCGAGACCAGAAGTATTGCTATGGCTTCTT
AAATCAGAATGTTACAGCACCGGTTACGTATTTCGTACCTGTATGTACGACAGTGATATGTGTAAGAACTCTC
TTCATTACTATATATCGTCTCATAGAGAATCTCAATCTCTATCCAAGGATGTAATTAAATGTTTGATCAATAACA
ATGTTTCCATCCATGGCAGAGACGAAGGAGGATCTTTACCCATCCAATACTACTGGTCTTGCTCAACCATAG
ATATAGAGATTGTTAAATTATTAATAAAGGATGTGGACACGTGTAGAGTATACGACGTCAGCCCTATATTAGA
GGCGGATTATCTAAACAAGCGATTTAGAGTAACCCCATATAATGTAGACATGGAAATCGTTAATCTTCTTATT
GAGAGACGTCATACTCTTGTCGACGTAATGCGTAGTATTACTTCTTAGTGGTCGTCCGAGTACACGATGTGT
CGTTGACGGGATACAGATTAATTTCCACATCGATATAGTTAAAGGTATTTCTGGGTACGGGTTTGAGATCGT
CGTACATGGGAAATGAAATGTGACTGTCTGAATGTATGGCTTTAAGATAGCTGTGATACCGTATACAGGTCG
GTGTCGGAGATTCGAATCTCTTTAAGGCGACTTATGTCACGATGATGGAATCTATCTTATCGAATGATATATT
TTTCATAAATACACTTTTATAGTCCTCGTTTAAACAGAATTTACTATGTAGTTCCGCGAATGACTCGTCCCTTA
ATAGGCAGTAGGCTAGTATCTTTTTTACGTAGTAATCGTCGTAGGGAGAGACATCTTGTAGAACAACGATTT

FIG. 11B

```
AATCATAGGTAGAGATACTTTCAGTCTGTGGTGGATGATGTCATTCACAACATCCGCCTTGTATATGATGTTT
CTGTTTTCAAACACCAAGTCGAATACCGTCTTTAGTCGGAAGGTTGATGTCGTATCCGATGTATGAGGCAAC
ATTGTTGTTACAATTTTGAAAGGCGGTATTATAGTATTCGTCTTTCTGAATGTCGAACCTATCTAGTAGATACC
GTAGTATATTGAGAGTGTATCCTTGATTATGTTTTATGAATAGATAAAGTAGATGTTGTCCTTCTTCCTTTTGT
TCGTGCCAATTGAGTAACATTATGAGAATATGACCTGTTGCACAATCGTTCCATGATGGGTGTACAATCAAG
ATTATTACGTATCCTCGTATCGGCTCCTCGAGATAAAAGAGCATACACCACACGAGGACTATGTTTGGTATAC
TGTTGAAGGTAAGTGTGTAACCGCGTTAATGTTTGCTCCATAATCTATTATCGCGTAGATGAATCGCTTCTCG
GCTCGCATCTTAGTGTGACTTAACTTGTAATAATTGCTTTTGTAGAACGTGGATATGTGTTTACAGTAGTAAT
GAAGAGAAGTGAGTCCATCCTCGTCGACGCAATTAGGGTCGGATCCTTTGTACAGAACGTAATAGTTTAAG
CTCCCATTGAATTTATATCTAAGATAACACAGCAATAGATCGGATGATTTACTAAAGTCATCAATGGTGTCCG
TTAGTATATCAAAGATCTTGTTATCGATTGATAGTGAATGAATCAGATAGTGGTGTAGAGGAATATGTCCTTT
TTCATCCTTGCTATCAAAGTTACGCATGCCGTGGTGTAACAATATCTTTAATACAGATGGATTAAATCGTGTAT
TCATCGTATAGCAATGTAATGGAGAGTTACCTCGTTTATTCAGATCGCAGTGTTTAATAACTAGCTTAAACAG
ATGAGACGATGTATCCACATCAAAGAACGTAAAATACATATGACAAACATTGTTGACAGAAACGTGACCTTC
ATTCTTACCGTCGTCCATAAATACGTTAGGTATGTACCACATACTGTCGCGAACGATGCGTACAATCTCGTCC
ATCTCATAATGATTTACTTTTTCATAATTAAAGATGTGAAAGAAAACCGAACAATATATTTTTTTAGTAATGTT
TATGCGAGACATATAAAATAAACTCCGTGTTTATGATCATTTTTAACAGCAACACATTCAATATTGTATTGTTT
TATTTTATATTATTTACACAATTAACAATATATTATTAGTTTATATTACTGAATTAATAATATAAATTCCCAATCTT
GTCATAAACACACACTGAGAAACAGCATAAACACAAAATCCATCAAAAATGTCGATGAAATATCTGATGTTG
TTGTTCGCTGCTATGATAATCAGATCATTCGCCGATAGTGGTAACGCTATCGAAACGACATCGCCAGAAATT
ACAAACGCTACAACAGATATTCCAGCTATCAGATTATGCGGTCCAGAGGGAGATGGATATTGTTTACACGGT
GACTGTATCCACGCTAGAGATATTGACGGTATGTATTGTAGATGCTCTCATGGTTATACAGGCATTAGATGTC
AGCATGTAGTATTAGTAGACTATCAACGTTCAGAAAACCCAAACACTACAACGTCATATATCCCATCTCCCGG
TATTATGCTTGTATTAGTAGGCATTATTATTATTACGTGTTGTCTATTATCTGTTTATAGGTTCACTCGACGAAC
TAAACTACCTATACAAGATATGGTTGTGCCATAATTTTTATAAATTTTTTTATGAGTATTTTTACAAAAAAAT
GTATAAAGTGTATGTCTTATGTATATTTATAAAAATGCTAAGTATGCGATGTATCTATGTTATTTGTATTTATCTA
AACAATACCTCTACCTCTAGATATTATACAAAAATTTTTTATTTCGGCATATTAAAGTAAAATCTAGTTACCTTG
AAAATGAATACAGTGGGTGGTTCCGTATCACCAGTAAGAACATAATAGTCGAATACAGTATCCGATTGAGAT
TTTGCATACAATACTAGTCTAGAAAGAAATTTGTAATCATCTTCTGTGACGGGAGTCCATATATCTGTATCATC
GTCTAGTTTATCAGTGTCCCATGCTATATTCCTGTTATCATCATTAGTTAATGAAAATAACTCTCGTGCTTCAG
AAAAGTCAAATATTGTATCCATACATACATCTCCAAAACTATCGCTTATACGTTTATCTTTAACGATACCTATAC
CTAGATGGTTATTTACTAACAGACATTTTCCAGATCTATTGACTATAACTCCTATAGTTTCCACATCAACCAAG
TAATGATCATCTATTGTTATATAACAATAACATAACTCTTTTCCATTTTTATCAGTATGTATATCTATATCAACGTC
GTCGTTGTAGTGAATAGTAGTCATTGATCTATTATATGAAACGGATATGTCTAGAACGGCAATTGTTTTACGT
CCAGTTAACACTTTCTTTGATTTAAAGTCTAGAGTCTTTGCAAACATAATATCCTTATCCGACTTTATATTTCCT
GTAGGGTGGTATAATTTTATTTTGCCTCCACATATCGGTGTTTCCAAATATATTACTAGACAATATTCCATATAG
TTATTAGTTAAGGGTACCCAATTAGAACACGTACGCTTATTATCATCATTTGGATCGTATTTCATAAAAGTTAT
TGTACTATCGATGTCAACACATTCTACATTTTTTAATCGTCTATATAGTATTTTTCTGATATTTTCTATAATATCA
GAATTGTCTTCCATCGGAAGTTGTATACTATCGGAATCAGTTACATGTTTAAATAATTCTCTGATGTCATTCCT
TATACAATCAAATTCATTATTAAACAGTTTAATAGTCTGTAGACCTTTATCGTCGTAAATATCCATTGTCTTATT
AGTTACGCTTATTTTTATGTGTGTTTTACGTTGCTTTATTATATTTTATAAGAATGATTGTTTGACGAATCACGAG
AACTATTAAGACACATTATTAGGTATATATTATAAAAAAGTTTTTGATTACGATGTTATAAGAGGAAAGAGGA
CACATTAACATCATACATCAATTAACTACATTCTTATAACATCGTAATCAAAAGAATTGCAATTTTGATGTATAA
CAACTGTCAATGGGTTATGGAATTGTATATTACATATTATACGGTATGTTGGTAACGACAAATACCGATCGGT
```

FIG. 11C

```
AATTGTCTGCCGGTGTAATAGAATTATATATATCTATCTATTACACCGGCTGAGTATGCATAATAATAAGTTGTG
GTAGTATGATCTCCATATTTATAATTTAGGACTTTGTATTCAGTATTTTTGGAATCATAAAAAATAAAAAAAAG
TTTTACTAATTTAAAATTTAAAAAGTATTTACATTTTTTTCACTGTTTAGTCGCGGATATGGAATTCGATCCTG
CCAAAATCAATACATCATCTATAGATCATGTAACAATATTACAATACATAGATGAACCAAATGATATAAGACTA
ACAGTATGCATTATCCGAAATATTAATAACATTACATATTATATCAATATCACAAAAATAAATACACATTTGGCT
AATCAATTTCGGGCTTGGAAAAAACGTATCGCCGGAAGGGACTATATGACTAACTTATCTAGAGATACAGG
AATACAACAATCAAAACTTACTGAAACTATACGTAACTGTCAAAAAAATAGAAACATATATGGTCTATATATAC
ACTACAATTTAGTTATTAATGTGGTTATTGATTGGATAACCGATGTGATTGTTCAATCAATATTAAGAGGGTT
GGTAAATTGGTACATAGCTAATAATACCTATACTCCAAATACACCCAATAATACAACAACCATTTCTGAGTTG
GATATCATCAAAATACTGGATAAATACGAGGACGTGTATAGAGTAAGTAAAGAAAAGAATGTGGAATTTG
CTATGAAGTTGTTTACTCAAAACGATAGATACTTTGGTTTATTGGATTCGTGTACTCATATATTTTGCATAACA
TGCATCAATATATGGCATAAAACACGAAGAGAAACCGGTGCGTCGGATAATTGTCCTATATGTCGTACCCGT
TTTAGAAACATAACAATGAGCAAGTTCTATAAGCTAGTTAACTAATAAATAAAAAGTTTAATTTGTTGACGAC
GTATGTCGTTATTTTTCTCGTATGAAAGATTAAATTCAATTCAATTCGTTGTTTCTAATATAATCTGCCGTATTG
GATGGATTCTCAAGACAATTGCATTTAGATTATATTATCATGAATAAAAATAGTAGCACGCACTACTTCAGCC
AAATATTCTTTTTTGAAACGCCATCTATCGTAGTGAGGACACAAGTGAACCTATAATTATCAAATTTATTAGTA
TCAGTCACATGAAGGACTTTCTGTAGAGTGACGATTCTACCATCTATGGTACTAACGGTTTCATCCTCCTTGA
TACCCTCACCCAAATGTTCTATAAATTTAGCATCCTCGTCCGATCTCATATCCTTTGCCAACCAATACATGTAG
CTAAAATTAGGCATAAATTTCACACATCCAGTGCAACGAAATTCTCCAGAAGATGTTACGATGTTTAGGTTA
GGACATTTGATTTCGTCGGCATTAACATATGGGTGAACACACCCATACATGAAAGCGATGAGAAATAGGAT
TCTCATCTTGCCAAAATATCACTAGAAAAAATTTATTTATCAATTTTAAAGGTATAAAAAATACTTATTGTTGC
TCGAATATTTTGTATTTGATGGTATACGGAAGATTAGAAATGTAGGTATTATCATCAACTGATTCTATGGTTTT
ATGTATTCTATCATGTTTCACTATTGCGTCGGAAATAATATCATATGCTTCCACATATATTTTATTTTGTTTTAAC
TCATAATACTCACGTAATTCTGGATTATTGGCATATCTATGAATAATTTTAGCTCCATGATCAGTAAATATTAAT
GAGAACATAGTATTACCACCTACCATTATTTTTTTCATTTCGTTCAATTCTTGATTGCAAAGATCTATATAATCA
TTATAGCGTTGACTTATGGACTCTGGAATCTTAGACGATGTACAGTCATCTATAATCATGGCATATTTAATACA
TTGTTTTATAGCATAGTAGTTATCTACGATGTTAGATATTTCTCTCAATGAATCAATCACACAATCTAATGTAGG
TTTATGACATAATAGCATTTTCAGCAGTTCAATGTTTCTAGATTCGTTGATGGCAATGGCTATACATGTATATC
CGTTATTTGATCTAATGTTGACATCTGAACCGGATTCTAGCAGTAAAGATACTAGAGATTGTTTATTATATCTA
ACAGCCTTGTGAAGAAGTGTTTCTCCTCGTTTGTCAATCATGTTAATGTCTTTAAGATAAGGTAGGCAAATG
TTTATAGTACTAAGAATTGGGCAAGCATAAGACATGTCACAAAGACCCTTTTTGTATGTATAAGTGTAAAAAT
TATAACATTCATAGTTGGATTTACATAGGTGTCCAATCGGGATCTCTCCATCATCGAGATAATTGATGGCATCT
CCCTTCCTTTTTTAGTAGATATTTCATCGTGTAAGAATCAATATTAATATTTCTAAAGTATTCGTGTATAGCCTC
TTTATTTACCACAGTTCCATATTCCACTAGAGGGATATCGCCGAATGTCATATACTCAATTAGTATATGTTGGA
GGACATCCGAGTTCATTGTTTTCAATATCAAAAAGATGGTTTCCTTATCATTTCTCCATAGTGGTACAATACTA
CACATTATTCCGTGCGGCTTTCCATTTTCCAAAAACAATTTGACCAAATCTAAATCTACATCTTTATTGTATCT
ATAATCACTATTTAGATAATCAGCCATAATTACTCGAGTGCAACATGTTAGATCGTCTATATATGAATAAGCAG
TGTTATCTATTCCTTTCATTAACAATTTAACGATGTCTATATCTATATGAGATGACTTAATATAATATTGAAGAGC
TGTACAATAGTTTTTATCTATAGAAGACGGCTTGATTCCGTGATTAATTAGACATTTAACAACTTCCGGACGC
ACATATGCTCTCGTATCCGACTTTGAATACAGATGAGAGATGATATACAGATGCAATACGGTACCGCAATTTC
GTAGTTGATAATCATCATACGCGTATCAGTACTCGTCCTCATAAAGAACACTGCAGCCATTTTCTATGAACAA
ATCAATAATTTTAGGAACAGGATCATTGTCATTACATAATTTTCTATAACTGAACGATGGTTTTCACATTTAAC
ACTCAAGTCAAATCCATGTTCTACCAACACCTTTATCAAGTCAACGTCTACATTTTTGGATTTCATATAGCTG
AATATATTAAAGTCATTTATGTTGCTAAATCCAGTGGCTTCTAGTAGAGCCATCGCTATATCCTTTAACTTTAA
```

FIG. 11D

```
CATGTCTACTATTTGTGTATTCTTCTAATGGGGTAGCTGTCTCCAATTTTTGCGTAATGGATTAGTGCCACTGT
CTAGTAGTAGTTTGACGACCTCGACATTATTACAATGCTCATTAAAAAGGTATGCGTGTAAAGCATTATTCTT
GAATTGGTTCCTGGTATCATTAGGATCTCTGTCTCTCAACATCTGTTTAAGTTCATCGAGAGCCACCTCCTCA
TTTTCCAGATAGTCAAACATTTTGACTGAATGAGCTACTGTGAACTCTATACACCCACACAACTAATGTCATT
AAATATTATTTTTTTGAATGTATTTATACCATGTCAAAAACTTGTACAATTATTAATAAAAATAATTTAGTGTTT
AAATTTTACCAGTTCCAGATTTTACACCTCCGTTAACCCCACTTTTTACACCACTGGACGATCCTCCTCCCCA
CATTCCACCGCCACCAGATGTATAAGTTTTAGATCCTTTATTACTACCATCATGTCCATGGATAAAGACACTCC
ACATGCCGCCACTACTACCCCCTTTAGAAGACATATTAATAAGACTTAAGGACAAGTTTAACAATAAAATTA
ATCACGAGTACCCTACTACCAACCTACACTATTATATGATTATAGTTTCTATTTTTACAGTACCTTAACTAAAGT
CTCTAGTCACAAGAGCAATACTACCAACCTACACTATTATATGATTATAGTTTCTATTTTTATAGGAACGCGTA
CGAGAAAATCAAATGTCTAATTTCTAACGGTAGTGTTGATAAACGATTATCGTCAATGGATACCTCCTCTATC
ATGTCGTCTATTTTCTTACTTTGTTCTATTAACTTATTAGCATTATATATTATTTGATTATAAAACTTATATTGCTT
ATTAGCCCAATCTGTAAATATCGGATTATTAACATATCGTTTCTTTGTAGGTTTATTTAACATGTACATCACTGT
AAGCATGTCCGTACCATTTATTTTAATTTGACGCATATCCGCAATTTCTTTTTCGCAGTCGGTTATAAATTCTA
TATATGATGGATACATGCTACATGTGTACTTATAATCGACTAATATGAAGTACTTGATACATATTTTCAGTAACG
ATTTATTATTACCACCTATGAATAAGTACCTGTGATCGTCTAGGTAATCAACTGTTTTCTTAATACATTCGATGG
TTGGTAATTTACTCAGAATAATTTCCAATATCTTAATATATAATTCTGCTATTTCTGGGATATATTTATCTGCCAG
TATAACACAAATAGTAATACATGTAAACCCATATTTTGTTATTATATTAATGTCTGCGCCATTATCTATTAACCAT
TCTACTAGGCTGACACTATGCGACTTAATACAATGATAAAGTATACTACATCCATGTTTATCTATTTTGTTTATA
TCATCAATATACGGCTTACAAAGTTTTAGTATCGATAACACATCCAACTCACGCATAGAGAAGGTAGGGAAT
AATGGCATAATATTTATTAGGTTATCATCATTGTCATTATCTACAACTAAGTTTCCATTTTTTAAAATATACTCGA
CAACTTTAGGATCTCTATTGCCAAATTTTTGAAAATATTTATTTATATGCTTAAATCTATATAATGTAGCTCCTTC
ATCAATCATACATTTAATAACATTGATGTATACTGTATGATAAGATACATATTCTAACAATAGATCTTGTATAGA
ATCTGTATATCTTTTAAGAATTGTGGATATTAGGATATTATTACGTAAACTATTACACAATTCTAAAATATAAAA
CGTATCACGGTCGAATAATAGTTGATCAACTATATAATTATCGATTTTGTGATTTTTCTTCCTAAACTGTTTACG
TAAATAGTTAGATAGAATATTCATTAGTTCATGACCACTATAGTTACTATCGAATAACGCGTCAAATATTTCCC
GTTTAATATCGCATTTGTCAAGATAATAATAGAGTGTGGTATGTTCACGATAAGTATAATAACGCATCTCTTTT
TTGTGTGAAATTAAATAGTTTATCACGTCCAAAGATGTAGCATAACCATCTTGTGACCTAGTAATAATATAATA
ATAGAGAACTGTTTTACCCATTCTATCATCATAATCAGTGGTGTAGTCGTAATCGTAATCGTCTAATTCATCAT
CCCAATTATAATATTCACCAGCACGTCTAATCTGTTCTATTTTGATCTTGTATCCATACTGTATGTTGCTACATG
TAGGTATTCCTTTATCCAATAATAGTTTAAACACATCTACATTGGGATTTGATGTTGTAGCGTATTTCTCTACA
ATATTAATACCATTTTTGATACTATTTATTTCTATACCTTTCGAAATTAGTAATTTCAATAAGTCTATATCGATGT
TATCAGAACATAGATATTCGAATATATCAAAATCATTGATATTTTTATAGTCGACTGACGACAATAACAAAATC
ACAACATCGTTTTTGATATTATTATTTTTCTTGGTAACGTATGCCTTTAATGGAGTTTCACCATCATACTCATAT
AATGGATTTGCACCACTTTCTATCAATGATTGTGCACTGCTGGCATCGATGTTAAATGTTTTACAACTATCATA
GAGTATCTTATCGTTAACCATGATTGGTTGTTGATGCTATCGCATTTTTTGGTTTCTTTCATTTCAGTTATGTAT
GGATTTAGCACGTTTGGGAAGCATGAGCTCATATGATTTCAGTACTGTAGTGTCAGTACTATTAGTTTCGATC
AGATCAATGTCTAGATCTATAGAATCAAAACACGATAGGTCAGAAGATAATGAATATCTGTACGCTTCTTTTT
GTACTGTAACTTCTGGTTTTGTTAGATGGTTGCATCGTGCTTTAACATCAATGGTACAAATTTTATCCTCGCTT
TGTGTATCATATTCGTCTCTAGTATAAAATTCTATATTCAGATTATCATGCGATGTGTATACGCTAACGGTATCA
ATAAACGGAGCACACCATTTAGTCATAACAGTAATCCAAAATTTTTTAAAGTATATCTTAACGAAAGAAGTT
GTGTCATTGTCTACGGTGTATGGTACTAGATCCTCATAAGTGTATATATCTAGAGTAATGTTTAATTTATTAAAT
GGTTGATAATATGGATCCTCATGACAATTTCCGAAGATGGAAATGAGATATAGACATGCAATAAATCTAATCG
AAGACATGGTTACTCCTTAAAAAAAATACGAATAATCACCTTGGCTATTTAGTAAGTGTCATTTAACACTATAC
```

FIG. 11E

TCATATTAATCCATGGACTCATAATCTCTATACGGGATTAACGGATGTTCTATATACGGGGATGAGTAGTTTTC
TTCTTTAACTTTATACTTTTTACTAATCATATTTAGACTGATGTATGGGTAATAGTGTTTAAAGAGTTCGTTCTC
ATCATCAGAATAAATCAATATCTCTGTTTTTTTGTTATACAGATGTATTACAGCCTCATATATTACGTAATAGAA
CGTGTCATCTACCTTATTAACTTTCACCGCATAGTTGTTTGCAAATACGGTTAATCCTTTGACCTCGTCGATTT
CCGACCAATCTGGGCGTATAATGAATCTAAACTTTAATTTCTTGTAATCATTCGAAATAATTTTTAGTTTGCAT
CCGTAGTTATCCCCTTTATGTAACTGTAAATTTCTCAACGCGATATCTCCATTAATAATGATGTCGAATTCGTG
CTGTATACCCATACTGAATGGATGAACTAACGAATATCAACGGCGTTAATAGTAATTTACTTTTTCATCTTTAC
ATATTGGGTACTAGTTTTACTATCATAAGTTTATAAATTCCACAAGCTACTATGGAATAAGCCAACCATCTTAG
TATACCACACATGTCTTAAAGTTTATTAATTAATTACATGTTGTTTTATATATATCGCTACGAATTTAAAGAGAA
ATCAGTTTAGGAAGAAAAAAATTATCTATCTACATCATCACGTCTCTGTATTCTACGATAGAGTGCTACTTTAA
GATGAGACATATCCGTGTCATCAAAAATATACTCCATTAAAATGATTATTCCGGCAGCGAACTTGATATTGGA
TATATCACAACCTTTGTTAATATCTACGACAATAGACAGCAGTCCCATGGTTCCATAAACAGTGAGTTTATCTT
TCTTTGAAGCGATAGTTTGTAGAGATCTTATAAAACCGTCAAACGACATCGCATTTATATCTTTAGCTAATTC
ATATATGTTACCATCGTAATATCTAACCGCGTCTATCTTAAACGTTTCCATCGCTTTAAAGACGTTTCCGATAG
ATGGTCTCATTTCATCAGTCATACTGAGCCAACAAATATAATCGTGTATAACATCTTTGATAGAATCAGACTCT
AAAGAAAACGAATCGGCTTTATTATACGCATTCATGATAAACTTAATGAAAAATGTTTTTCGTTGTTTAAGTT
GGATGAATAGTATGTCTTAATAATTGTTATTATTTCATTAATTAATATTTAGTAACGAGTACACTCTATAAAAAC
GAGAATGACATAACTAGTTATCAAAGTGTCTAGGACGCGTAATTTTCATATGGTATAGATCCTGTAAGCATTG
TCTGTATTCTGGAGCTATTTTCTTTATCGCATTAGTAAGTTCAGAATATGTTATAAATTTAAATCGAATAACGA
ACATGACTTTAGTAAAGTCGTCTATATTAACTCTTTTATTTTCTAGCCATCGTAATACCATGTTTAAGATAGTAT
ATTCTCTAGTTACTACGATCTCATCGTTGTCTAGAATATCACATACTGAATCTACATCCAATTTTAGAAATTGGT
CTGTGTTACATATCTCTTCTATATTATTGTTGATGTATTGTCGTAGAAAACTATTACGTAGACCATTTTCTTTATA
AAACGAATATATAGTACTCCAATTATCTTTACCGATATATTTGCACACATAATCCATTCTCTCAATCACTACATCT
TTAAGATTTTCGTTGTTAAGATATTTGGCTAAACTATATAATTCTATTAGATCATCAACAGAATCAGTATATATT
TTTCTAGATCCAAAGACGAACTCTTTGGCGTCCTCTATAATATTCCCAGAAAAGATATTTTCGTGTTTTAGTT
TATCGAGATCTGATCTGTTCATATACGCCATGATTGTACGGTACGTTATGATAACCGCATAAAATAAAAATCCA
TTTTCATTTTTAACCAATACTATTCATAATTGAGATTGATGTAATACTTTGTTACTTTGAACGTAAAGACAGTA
CACGGATCCGTATCTCCAACAAGCACGTAGTAATCAAATTTGGTGTTGTTAAACTTCGCAATATTCATCAATT
TAGATAGAAACTTATACTCATCATCTGTTTTAGGAATCCATGTATTATTACCACTTTCCAACTTATCATTATCCC
AGGCTATGTTTCGTCCATCATCGTTGCGCAGAGTGAATAATTCTTTTGTATTCGGTAGTTCAAATATATGATCC
ATGCATAGATCGGCAAAGCTATTGTAGATGTGATTTTTCCTAAATCTAATATAAAACTCGTTTACTAGCAAAC
ACTTTCCTGATTTATCGACCAAGACACATATGGTTTCTAAATCTATCAAGTGGTGGGGATCCATAGTTATGAC
GCAGTAACATAGATTATTACATTCTTGACTGTCGCTAATATCTAAATATTTATTGTTATCGTATTGGATTCTGCA
TATAGATGGCTTGTATGTCAAAGATATAGAACACATAACCAATTTATAGTCGCGCTTTACATTCTCGAATCTAA
AGTTAAGAGATTTAGAAAACATTATATCCTCGGATGATGTTATCACTGTTTCTGGAGTAGGATATATTAAAGT
CTTTACAGATTTCGTCCGATTCAAATAAATCACTAAATAATATCCCACATTATCATCTGTTAGAGTAGTATCATT
AAATCTATTATATTTTATGAAAGATATATCACTGCTCACCTCTATATTTCGTACATTTTTAAACTGTTTGTATAAT
ATCTCTCTGATACAATCAGATATATCTATTGTGTCGGTAGACGATACCGTTACATTTGAATTAATGGTGTTCCA
TTTTACAACTTTTAACAAGTTGACCAATTCATTTCTAATAGTATCAAACTCTCCATGATTAAATATTTTAATAGT
ATCCATTTTATATCACTACGGACACAAAGTAGCTGACATAAACCATTGTATAATTTTTATGTTTTATGTTTATTA
GCGTACACATTTTGGAAGTTCCGGCTTCCATGTATTTCCTGGAGAGCAAGTAGATGATGAGGAACCAGATA
GTTTATATCCGTACTTGCACTTAAAGTCTACATTGTCGTTGTATGAGTATGATCTTTTAAACCCGCTAGACAA
GTATCCGTTTGATATTGTAGGATGTGGACATTTAACAATCTGACACGTGGGTGGATCGGACCATTCTCCTCC
TGAACACAGGACACCAGAGTTACCAATCAACGAATATCCACTATTGCAACTATAAGTTACAACGCTCCCATC

FIG. 11F

```
GGTATAAAAATCCTCGTATCCGTTATGTCTTCCGTTGGATATAGATGGAGGGGATTGGCATTTAACAGATTCA
CAAATAGGTGCCTCGGGATTCCATACCATAGATCCAGTAGATCCTAATTCACAATACGATTTAGATTCACCGA
TCAACTGATATCCGCTATTACAAGAGTACGTTATACTAGAGCCAAAGTCTACTCCGCCAATATCAAGTTGGCC
ATTATCGATATCTCGAGGCGATGGGCATCTCCGTTTAATACATTGATTAAAGAGTGTCCATCCAGTACCTGTA
CATTTAGCATATATAGGTCCCATTTTTTGCTTTCTGTATCCAGGTAGACATAGATATTCTATAGTGTCTCCTATG
TTGTAATTAGCATTAGTTTCCACACTATTCTTAAATTTTATATTAATGGGACGTGAAGGAATAGGACAGTATG
ATAGAACGCATCCTATTCCCAACAATGTCAGGAACGTCACGCTCTCCACCTTCATATTTATTTATCCGTAAAA
ATGTTATCCTGGACATCGTACAAATAATAAAAAAGCCCATATATGTTTGCTATTGTAGAAATTGTTTTTCACAG
TTGCTCAAAAACGATGGCAGTGACTTATGAGTTTCATCTTTAGTAAACATATCATAATATTCGATATTACGAGT
TGACATATCGAACAAATTCCAAGTATTTGATTTTGGATAATATTCGTATTTTGCATCTGCTATAATTAAGATATA
ATCACCGCAAGAACACACGAACATCTTTCCTACATGGTTAAAGTACATGTATAATTCTATCCATTTGTCTTCCT
TAACTATATATTTGTATAGATAATTACGAGTCTCATAAGTAATTCCAGTAATTGCATAGATGTCACCATCGTACT
CTACAGCATAAACTATACTATGATGTCTAGGCATGGGAGACTTTTTTATCCAACGATTTTTAGTGAAACATTC
TACATCGTTTAATACTACATATTTCTCATACGTGGTATAAACTCCACCCATTACATATATATCATCGTTTACGAAT
ACCGACGCGCCTGAATATCTAGGAGTAATTAAGTTTGGAAGTCTTATCCATTTCGAAGTGCCGTGTTTCAAA
TATTCTGCCACACCCGTTGAAATAGAAAATTCTAATCCTCCTATTACATATAACTTTCCATCGTTAACACAAGT
ACTAACTTCTGATTTTAACGACGACATATTAGTAACCGTTTTCCATTTTTTCGTTTTAAGATCTACCCGCGATA
CGGAATAAACATGTCTATTGTTAATCATGCCGCCAATAATGTATAGACAATTATGTAAAACATTTGCATTATAG
AATTGTCTATCTGTATTACCGACTATCGTCCAATATTCTGTTCTAGGAGAGTAATGGGTTATTGTGGATATATA
ATCAGAGTTTTTAATGACTACTATATTATGTTTTATACCATTTCGTGTCACTGGCTTTGTAGATTTGGATATAGT
TAATCCCAACAATGATATAGCATTGCGCATAGTATTAGTCATAAACTTGGGATGTAAAATGTTGATGATATCTA
CATCGTTTGGATTTTTATGTATCCACTTTAATAATATCATAGCTGTAACATCCTCATGATTTACGTTAACGTCTT
CGTGGGATAAGATAGTTGTCAGTTCATCCTTTGATAATTTTCCAAATTCTGGATCGGATGTCACCGCAGTAAT
ATTGTTGATTATTTCTAACATCGACGCATTATATAGTTTTTTAATTCCATATTGTTTAGAAAAGTTAAACATCCT
TATACAATTTGTGGAATTAATATTATGAATCATAGTTTTTACACATAGATCTACTACAGGCGTAACATCAATTAT
TACGGCAGCAACTAGTATCATTTCTACATTGTTTATGGTGATGTTTATCTTCTTCCAGCGCATATAGTCTAATA
GCGATTCAAACGCGTGATAGTTTATACCATTCAATATAATCACTTCATCATTTATATGGTGCTCCTGAATGCGT
TTAAAAAAATTATACGGAGACGCCGTAATAATTTCCTTATTCACTTGTATAATTTCCCCATTGATAGAAAATAT
CACGCTTTCCATTCTTGAAGTACTATAAGTAATTATAGTATAATGTAAACGTTTATATATTCAATATTTTTATAAA
AATCATTTTGACATTAATTCCTTTTTAAATTTCCGTCTATCATCTATAGAAACGTATTCTATGAATTTATAAAATG
CTTTTACGTGTCCTATCGTAGGCGATAGAACCGCTAAAAAGCCTATCGAATTTCTACAAAAGAATCTATTATA
TGGTATAGGGAGAGTATAAAACATTAAATGCCCGTACTTATTAAAGTATTCAGTAGCCAATCCTAACTCTTTC
GAATACTTATTAATGGCTCTTGTTCTGTACGAATCTATTTTTTTGAACAACGGACCTAGTGGTATATCTTGTTC
TATGTATCTAAAATAATGTCTGACTAGATCCGTTAGTTTAATATCCTCAGTCATCTTGTCTAGAATGGCAAATC
TAACTGCGGGTTTAGGCTTTAGTTTAGTTTTTATATCTACATCTATGTCTTTATCTAACACCAAAAATATAATAG
CTAATATTTTATTACAATCATCCGGATATTCTTCTACGATCTCACTAACTAATGTTTCTTTGGTTATACTAGTATA
GTCACGATCAGACAAATAAAGAAAATCAGATGATCGATGAATAATACATTTAAATTCATCATCTGTAAGATTT
TTGAGATGTCTCATTAAAATATTATTAGGGTTAGTACTCATTATCATTCGGCAGCTATTACTTATTTTATTATTTT
TCACCATATAGATCAATCATTAGATCATCAAAATATGTTTCAATCATCCTAAAGAGTATGGTGAATGACTCTTC
CCATCTAATTTCTGAACGTTCACCAATGTCTCTAGCCACTTTGGCACTAATAGCGATCATTCGCTTAGCGTCT
TCTATATTATTAACTGGTTGATTCAATCTATCTAGCAATGGACCGTCGGACAGCGTCATTCTCATGTTCTTAAT
CAATGTACATACATCGCCGTCATCTACCAATTCATCCAACAACATAAGCTTTTTAAAAATCATCATTATAATAGG
TTTGATCGTTGTCATTTCTCCAAAGAATATATCTAATAAGTAGAGTCCTCATGATTAGTTAACAACTATTTTTTA
TGTTAAATCAATTAGTACACCGCTATGTTTAATACTTATTCATATTTTTAGTTTTTAGGATTGAGAATCAATACAA
```

FIG. 11G

```
AAAATTAATGCATCATTAATTTTAGAAATACTTAGTTTCCACGTAGTCAATGAAACATTTGAACTCATCGTAC
AGGACGTTCTCGTACAGGACGTAACTATAAACCGGTTTATATTTGTTCAAGATAGATACAAATCCGATAACTT
TTTTTACGAATTCTACGGGATCCACTTTAAAAGTGTCATACCGGGTTCTTTTTATTCTTTTAAACAGATCAAT
GGTGTGATGTTGATTAGGTCTTTTACGAATTTGATATAGAATAGCGTTCACATATCCTCCATAATGGTCAATC
GCCATTTGTTCGTATGTCATAAATTCTTTAATTATATGACACTGTGTATTATTTAGTTCATCCTTGTTCATCATTA
GGAATCTATCCAAAATGGCAATTATACTAGAACTATAGGTGCGTTGTATACACATATTGATGTGTCTGTTTATA
CAATCCATGATATTTGGATCCATGCTACTACCTTCGGGTAAAATTGTAGCATCATATACCATTTCTAGTACTTTA
GGTTCATTATTATCCATTGCAGAGGACGTCATGATCGAATCATAAAAAAATATATTATTTTTATGTTATTTTGTT
AAAAATAATCATCGAATACTTCGTAAGATACTCCTTCATGAACATAATCAGTTACAAAACGTTTATATGAAGTA
AAGTATCTACGATTTTTACAAAAGTCCGGATGCATAAGTACAAAGTACGCGATAAACGGAATAATAATAGAT
TTATCTAGTCTATCTTTTTCTATAGCTTTCATAGTTAGATACATGGTCTCAGAAGTAGGATTATGTAACATCAG
CTTCGATAAAATGACTGGGTTATTTAGTCTTACACATTCGCTCATACATGTATGACCGTTAACTACAGAGTCT
ACACTAAAATGATTGAACAATAGATAGTCTACCATTGTTTCGTATTCAGATAGTACAGCGTAGTACATGGCAT
CTTCACAAATTATATCATTGTCTAATAGATATTTGACGCATCTTATGGATCCCACTTCAACAGCCATCTTAAAAT
CGGTAAAATCATATTGCTTTCCTTTATCATTAATAATTTCTAAAACATCATCTCTATCATAAAAGATACAAATATT
AACTGTTTGATCCGTAATAACATTGCTAGTCGATAGCAATTTGTTAATAAGATGCGCTGGGCTCAATGTCTTA
ATAAGAAGTGTAAGAGGACTATCTCCGAATTTGTTTTGTTTATTAACATCCGTTGATGGAAGTAAAAGATCT
ATAATGTCTACATTCTTGACTGTTTTAGAGCATACAATATGGAGAGGTGTATTTCCATCATGATCTGGTTTTGA
GGGACTAATTCCTAGTTTCATCATCCATGAGATTGTAGAAGCTTTTGGATTGTCTGACATAAGATGTCTATGA
ATATGATTTTTGCCAAATTTATCCACTATCCTGGCTTCGAATCCGATGGACATTATTTTTTTAAACACTCTTTCT
GAAGGATCTGTACACGCCAACAACGGACCACATCCTTCTTCATCAACCGAGTTGTTAATCTTGGCTCCATAC
TGTACCAATAAATTTATTCTCTCTATGACTTCATCATCTGTTCCCGAGAGATAATATAGAGGTGTTTTATTATGT
TTATCACACGCGTTTGGATCTGCGCCGTGCGTCAGCAGCATCGCGACTATTCTATTATTATTAATTTTAGAAG
CTATATGCAATGGATAATTTCCATCATCATCCGTCTCATTTGGAGAGTATCCTCTATGAAGAAGTTCTTCGACA
AATCGTTCATCTAGTCCTTTAATTCCACAATACGCATGTAGAATGTGATAATTATTTCCAGAAGGTTCGATAGC
TTGTAGCATATTCCTAAATACATCTAAATTTTTACTATTATATTTGGCATAAAGAGATAGATAATACTCGGCCGA
CATAATGTTGTCCATTGTAGTATAAAAATTAATATTTCTATTTCTATTTCTGTATATTTGCAACAATTTACTCTCT
ATAACAAATATCATAACTTAGTTCTTTTATGTCAAGAAGGCACTGGTTTAGTTCATCTATAAATGTCACGCCAT
AACTACCACGCATGCCATACTCAGAATTATGATAAAGATATTTATCCTTGGGGTGTAGGTAATGGGGATTAAT
CTTTGTTGGATCAGTCTCTAAGTTAACACATGTCACACATGATCCATTTATAGTTATATCACACGATGATGATT
TATGAATTGATTCCGGAAGATCGCTATCGTATTTTGTGGTTCCACAATTCATTTCCATACATGTTATTGTCACA
CTAATATTATGATGAACTTTATCTAGCCGCTGAGTGGTAAACAACAGAACAGATAGTTTATTATCTTTACCAA
CACCCTCAGCCGCTGCCACAAATCTCTGATCCGTATCCATGATGGTCATGTTTATTTCTAGTCCGTATCCAGTC
AACACTATGTTAGCATTTCTGTCGATATAGCTTTCACTCATATGACACTCACCAATAATAGTAGAATTAATGTC
GTAATTTACACCAATAGTGAGTTCGGCGGCAAAGTACCAATACCGGTAATCTTGTCGAGGAGGACATATAG
TATTCTTGTATTCTACTGAATACCCGAGAGATGCGATACAAAAGAGTAAGACTAATTTGTAAACCATCTTACT
CAAAATATGTAACAATAGTACGATGCAATGAGTAAGACAATAGGAAATCTATCTTATATACACATAATTATTCT
ATCAATTTTACCAATTAGTTAGTGTAATGTTAACAAAAATGTGGGAGAATCTAATTAGTTTTTCTTTACACAA
TTGACGTACATGAGTCTGAGTTCCTTGTTTTTGCTAATTATTTCATCCAATTTATTATTCTTGACTATATCGAGA
TCTTTTGTATAGGAGTCAGACTTGTATTCAACATGCTTTTCTATAATCATTTTAGCTATTTCGGCATCATCCAAT
AGTACATTTTCCAGATTAGCAGAATAGATATTAATGTCGTATTTGAACAGAGCCTGTAACATCTCAATGTCTT
TATTATCTATAGCCAATTTAATGTCCGGAATGAAGAGAAGGGAATTATTGGTGTTTGTCGACGTCATATAGTC
GAGCAAGAGAATCATCATATCCACGTGTCCATTTTTTATAGTGGTGTGAATACAACTAAGGAGAATAGCCAG
ATCAAAAGTAGATGGTATCTCTGAAAGAAAGTAGGAAACAATACTTACATCATTAAGCATGACGGCATGATA
```

FIG. 11H

AAATGAAGTTTTCCATCCAGTTTTCCCATAGAACATCAGTCTCCAATTTTTCTTAACAAACAGTTTTACCGTT
TGCATGTTACCACTATCAACCGCATAATACAATGCGGTGTTTCCCTTGTCATCAAATTGTGAATCATCCAGTC
CACTGAATAGCAAAATCTTTACTATTTTGGTATCTTCCAATGTGGCTGCCTGATGTAATGGAAATTCATTCTCT
AGAAGATTTTTCAATGCTCCAGCGTTCAACAACGTACATACTAGACGCACGTTATTATCAGCTATTGCATAAT
ACAAGGCACTATGTCCATGGACATCCGCCTTAAATGCATCTTTGCTAGAGAGAAAGCTTTTCAGCTGCTTAG
ACTTCCAAGTATTAATTCGTGACAGATCCATGTCTGAAACGAGACGCTAATTAGTGTATATTTTTTCATTTTTT
ATAATTTTGTCATATTGCACCAGAATTAATAATATCTCTAATAGATCTGATTAGTAGATACATGGCTATCGCAAA
ACAACATATACACATTTAATAAAAATAATATTTATTAAGAAAATTCAGATTTCACGTACCCATCAATATAAATAA
AATAATGATTCCTTACACCGTACCCATATTAAGGAGATTCCACCTTACCCATAAACAATATAAATCCAGTAATA
TCATGTCTGATGATGAACACAAATGGTGTATTAAATTCCAGTTTTTCAGGAGATGATCTCGCCGTAGCTACC
ATGATAGTAGATGCCTCTGCTACAGTTCCTTGTTCGTCGACATCTATCTTTGCATTCTGAAACATTTTATAAAT
ATATAATGGGTCCCTAGTCATATGTTTAAACAACGCATTATCTGGATTAAACATACTAGGAGCCATCATTTCG
GCTATCGACTTAATATCCCTCTTATTTTCGATAGAAAATTTAGGGAGTTTAAGATTGTACACTTTATTCCCTAA
TTGAAACGACCAATAGTCTAATTTTGCAGCCGTAATAGAATCTGTGAAATGGGTCATATTATCACCTATTGCC
AGGTACATACTAATATTAGCATCCTTATACGGAAGGCGTACCATATCATATTCTTCGTCATCGATTGTGATTGT
ATTTCCTTGCAATTTAGTAACTACGTTCATCATGGGAACCGTTTTCGTACCGTACTTATTAGTAAAACTAGCAT
TGCGTGTTTTAGTGATATCAAACGGATATTGCCATATACCTTTAAAATATATAGTATTAATGATTGCCCATAGA
GTATTATTGTCGAGCATATTAGAATCTACTACATTAGACATACCGGATCTACGTTCTACTATAGAATTAATTTTA
TTAACCGCATCTCGTCTAAAGTTTAATCTATATAGGCCGAATCTATGATATTGTTGATAATACGACGGTTTAAT
GCACACAGTATTATCTACGAAACTTTGATAAGTTAGATCAGTGTACGTATATTTAGATGTTTTCAGCTTAGCTA
ATCCTGATATTAATTCTGTAAATGCTGGACCCAGATCTCTTTTTCTCAAATCCATAGTCTTCAATAATTCTATTC
TAGTATTACCTGATGCAGGCAATAGCGACATAAACATAGAAAACGAATAACCAAACGGTGAGAAGACAATA
TTATCATCTTGAATATTTTTATACGCTACTATACCGGCATTGGTAAATCCTTGCAGACGATAGGTAGACACTGA
ACACGTTAACGATAGTATCAATAACGCAATCATGATTTTATGGTATTAATAATTAACCTTATTTTTATGTTCGGT
ATAAAAATTATTGATGTCTACACATCCTTTTGTAATTGACATCTATATATCCTTTTGTATAATCAACTCTAATCAC
TTTAACTTTTACAGTTTTCCCTACCAGTTTATCCCTATATTCAACATATCTATCCATATGCATCTTAACACTCTCT
GCCAAGATAGCTTCAAAGTGAGGATAGTCAAAAAGATAAATATATAGAGCATAATCATTCTCGTATACTCTGC
CCTTTATTACATCACCCGCATTGGGCAACGAATAACAAAATGCAAGCATCTTGTTAACGGGCTCGTAAATTG
GGATAAAAATTATGTTTTTATATCTATTTTATTCAAGAGAATATTCAGGAATTTCTTTTTCCGGTTGTATCTCAT
CGCAGTATATATCATTTGTACATTGTTTCATATTTTTTAATAGTCTACACCTTTTAGTAGGACTAGTATCGTACA
ATTCATAGCTGTATTTTGAATTCCAATCACGCATAAAAATATCTTCCAATTGTTGACGAAGACCTAATCCATCA
TCCGGTGTAATATTAATAGATGCTCCACATGTATCCGTAAAGTAATTTCCTGTCCAATTTGAGGTACCTATATA
CGCCGTTTTATCGGTTACCATATATTTGGCATGGTTTACCCTAGAATACGGAATGGGAGGATCAGCATCTGG
TACAATAAATAGCTTTACTTCTATATTTATGTTTTTAGATTTTAGCATAGCGATAGATCTTAAAAAGTTTCTCAT
GATAAACGAAGATCGTTGCCAGCAACTAATCAATAGCTTAACGGATACTTGTCTGTCTATAGCGGCTCTTCT
TAATTCATCTTCTATATAAGGCCAAAACAAAATATTGCCTGCCTTCGAATAAATAATAGGGATAAAGTTCATAA
CAGATACATAAACGAATTTACTCGCATTTCTAATACATGACAATAAAGCGGTTAAATCATTGGTTCTTTCCATA
GTACATAGTTGTTGCGGTGCAGAAGCAATAAATACAGAGTGTGGAACACCACTTACGTTAATACTAAGAGG
ATGATCTGTATTATAATACGACGGATAAAAGTTTTTCCAATTATATGGTAGATTGTTAACTCCAAGATACCAGT
ATACCTCAAAAATTTGAGTGAGATCCGCTGCCAAGTTCCTATTATTGAAGATCGCAATACCCAATTCTTTGAC
CTGAGTTAGTGATCTCCAATCCATGTTAGCGCTTCCTAAATAAATATGTGTATTATCAGATATCCAAAATTTTG
TATGAAGAACTCCTCCTAGGATATTTGTAATATCTATGTATCGTACTTCAACTCCGGCCATTTGTAGTCTTTCA
ACATCCTTTAATGGTTTGTTAGATTTATTGACGGCTACTCTAACTCTTACTCCTCTTTTGGGTAATTGTACAAT
CTCGTTTAATATTATCGTGCCGAAATTCGTACCCACTTCATCCGATAAACTCCAATAAAAAGATGATATATCTA

FIG. 11I

```
GTGTTTTTGTGGTATTGGATAGAATTTCCCTCCACATGTTAAATGTAGACAAATATACTTTATCAAATTGCATA
CCTATAGGAATAGTCTCTGTAATCACTGCGATTGTATTATCCGGATTCATTTTATTTGTTAAAAAATAATCCTAT
ATCACTTCACTCTATTAAAAATCCAAGTTTCTATTTCTTTCATGACTGATTTTTTAACTTCATCCGTTTCCTTAT
GAAGATGATGTTTGGCACCTTCATAAATTTTTATTTCTCTATTACAATTTGCATGTTGCATGAAATAATATGCA
CCTAAAACATCGCTAATCTCATTGTTTGTTCCCTGGAGTATGAGAGTCGGGGGGTGTTAATCTTGGGAATTA
TTTTTCTAACCTTGTTGGTAGCCTTCAAGACCTGACTAGCAAATCCAGCCTTAATTTTTTCATGATTGATTAA
TGGGTCGTATTGGTATTTATAAACTTTATCCATATCTCTAGATACTGATTCTGGACATAGCTTTCCGACTGGCG
CATTTGGTGTGATGGTTCCCATAAGTTTGGCAGCTAGCAGATTCAGTTTTGAAACAGCATCTGCATTAACTA
GAGGAGACATTAGAATCATTGCTGTAAACAAGTTTGGATTATCGTAAGAGGCTAGTATAGAAATTGTTGCTC
CCATGGAATGCCCAATAAGAAGACTGGAACTCCTAAATAAGTAGATTTAATAGTTACCACGTGCTGTACCAC
ATCTCTAACATACGTACCAAAGTCATCAATCATCATTTTTTCACCATTACTTCTTCCATGTCCAATATGATCATG
TGAGAATACTAAAATTCCTAACGATGATATGTTTTCAGCTAGTTCGTCATAACGTCCAGAATGTTTACCAGCT
CCATGACTTATGAATACTAATGCCTTAGGATATGTAATAGGTTTCCAATATATGTAATCATTGTCCAGATTGAA
CATACAGTTTGCACTCATGATTCACGTTATATAACTATCAATATTAACAGTTCGTTTGATGATCATATTATTTTT
ATGTTTTATTGATAATTGTAAAAACATACAATTAAATCAATATAGAGGAAGGAGACGGCTACTGTCTTTTGTG
AGATAGTCATGGCGACTAAATTAGATTATGAGGATGCTGTTTTTTACTTTGTGGATGATGATAAAATATGTAG
TCGCGACTCCATCATCGATCTAATAGATGAATATATTACGTGGAGAAATCATGTTATAGTGTTTAACAAAGATA
TTACCAGTTGTGGAAGACTGTACAAGGAATTGATGAAGTTCGATGATGTCGCTATACGGTACTATGGTATTG
ATAAAATTAATGAGATTGTCGAAGCTATGAGCGAAGGAGACCACTACATCAATTTTACAAAAGTCCATGATC
AGGAAAGTCTATTCGCTACCATAGGAATATGTGCTAAAATCACTGAACATTGGGGATACAAAAAGATTTCAG
AATCTAGATTCCAATCATTGGGAAACATTACAGATCTGATGACCGACGATAATATAAACATCTTGATACTTTTT
CTAGAAAAAAAATTGAATTGATGATATAGGGGTCTTCATAACGCATAATTATTACGTTAGCATTCTATATCCGT
GTTAAAAAAAATTATCCTATCATGTATTTGAGAGTTTTATATGTAGCAAACATGATAGCTGTGATGCCAATAA
GCTTTAGATATTCACGCGTGCTAGTGTTAGGGATGGTATTATCTGGTGGTGAAATGTCCGTTATATAATCTAC
AAAACAATCATCGCATATAGTATGCGATAGTAGAGTAAACATTTTTATAGTTTTTACTGGATTCATACATCGTC
TACCCAATTTGGTTATAAATGAAATTGTCGCCAATCTTACACCCAACCCCTTGTTATCCATTAGTATAGTATTA
ACTTCGTTATTTATGTCATAAACTGTAAATGATTTTGTAGATGCCATATCATACATGATATTCATGTCCCTATTAT
AATCATTACTAACTTTATCACAATATATGTTGATAATATCTATATATGATCTAGTCTTTGTGGGCAACTGTCTATA
CAAGTCGTCTAAACGTTGTTTACTCATATAGTATCGAACAGCCATCATTACATGGTCCCGTTCCGTTGATAGA
TAATCGAGTATGTTAGTGGACTTGTCAAATCTATATACCATATTTTCTGGAAGTGGATATACATAGTCGTGATC
AACATTATTGCTAGCCTCATCTTCTATATCATGTACTATACCATTATCTATATCATCTACATAATCTACGATATTATT
ACACATAAACATCGACAACATACTATTGTTTATTATCTAAGTCCTGTTGATCCAAACCCTTGATCTCCTCTATTT
GTACTATCTAGAGATTGTACTTCTTCCAGTTCTGGATAATATATACGTTGATAGATTAGCTGAGCTATTCTATCT
CCAGTATTTACATTAAACGTACATTTTCCATTATTAATAAGAATGACTCCTATGTTTCCCCTATAATCTTCGTCT
ATTACACCACCTCCTATATCAATGCCTTTTAGTGACAGACCAGACCTAGGAGCTATTCTACCATAGCAAATCT
TAGGCATGGACATACTAATATCTGTCTTAATTAACTGTCTTTCTCCTGGAGGGATAGTATAATCGTAAGCGCT
ATACAAATCATATCCGGCAGCACCCGGCGATTGCCTAGTAGGAGATTTAGCTCTGTTAGTTTCCTTAACAAA
TCTAACTGGTGAGTTAATATTCATGTTGAACATAAAACTAATATTTTATTTCAAAATTATTTACCATCCCATATAT
TCCATGAATAAGTGTGATGATTGTACACTTCTATAGTATCTATATACGATTCACGATAAAATCCTCCTATCAATA
GCAGTTTATTATCCACTATGATCAATTCTGGATTATCCCTCGGATAAATAGGATCATCTATCAGAGTCCATGTA
TTGCTGGATTCACAATAAAATTCCGCATTTCTACCAACCAAGAATAACCTTCTACCGAACACTAACGCGCAT
GATTTATAATGAGGATAATAAGTGGATGGTCCAAACTGCCACTGATCATGATTGGGTAGCAAATATTCTGTA
GTTGTATCAGTTTCAGAATGTCCTCCCATTACGTATATAACATTGTTTATAGATGCCACTGCTGGATTACATCT
AGGTTTCAGAAGACTCGGCATATTAACCCAAGCAGCATCCCCGTGGAACCAACGCTCAACAGATGTGGGA
```

FIG. 11J

```
TTTGGTAGACCTCCTACTACGTATAATTTATTGTTAGCGGGTATCCCGCTAGCATACAGTCTGGGGCTATTCAT
CGGAGGAATTGGAATCCAATTGTTTGATATATAATTTACAGCTATAGCATTGTTATGTATTTCATTGTTCATCC
ATCCACCGATGAGATATACTACTTCTCCAACATGAGTACTTGTACACATATGGAATATATCTATAATTTGATCCA
TGTTCATAGGATACTCTATGAATGGATACTTGTATGATTTGCGTGGTTGTTTATCACAATGAAATATTTTGGTA
CAGTCTAGTATCCATTTTACATTATTTATACCTCTGGGAGAAAGATAATTTGACCTGATTACATTTTTGATAAG
GAGTAGCAGATTTCCTAATTTATTTCTTCGCTTTATATACCACTTAATGACAAAATCAACTACATAATCCTCATC
TGGAACATTTAGTTCATCGCTTTCTAGAATAAGTTTCATAGATAGATAATCAAAATTGTCTATGATGTCATCTT
CCAGTTCCAAAAAGTGTTTGGCAATAAAGTTTTTAGTATGACATAAGAGATTGGATAGTCCGTATTCTATACC
CATCATGTAACACTCGACACAATATTCCTTTCTAAAATCTCGTAAGATAAAGTTTATACAAGTGTAGATGATAA
ATTCTACAGAGGTTAATATAGAAGCACGTAATAAATTGACGACGTTATGACTATCTATATATACCTTTCCAGTA
TACGAGTAAATAACTATAGAAGTTAAACTGTGAATGTCAAGGTCTAGACAAACCCTCGTAACTGGATCTTTA
TTTTTCGTGTATTTTTGACGTAAATGTGTGCGAAAGTAAGGAGATAACTTTTTCAATATCGTAGAATTGACTA
TTATATTGCCACCTATAGCATCAATAATTGTTTTGAATTTCTTAGTCATAGACAATGCTAATATATTCTTACAGT
ACACAGTATTAACAAATATCGGCATTTATGTTTCTTTAAAAGTCAACATCTAGAGAAAAATGATTATCTTTTT
GAGACATAACTCCCATTTTTTGGTATTCACCCACACGTTTTTCGAAAAAATTAGTTTTTCCTTCCAATGATATA
TTTTCCATGAAATCAAACGGATTGGTAACATTATAAATTTTTTTAAATCCCAATTCAGAAATCAATCTATCCGC
GACGAATTCTATATATGTTTTCATCATTTCACAATTCATTCCTATAAGTTTAACTGGAAGAGCCGCAGTAAGA
AATTCTTGTTCAATGGATACTGCATCTGTTATAATAGATCTAACGGTTTCTTCACTCGGTGGATACAATAAATG
TTTAAACATCAAACATGCGAAGTCGCAGTGTAGACCCTCGTCTCTACTAATTAGTTCGTTGGAAAACGTGA
GTCCGGGCATTAGGCCACGCTTTTTAAGCCAAAATATGGAAGCGAATGATCCGGAAAAGAAGATTCCTTCT
ACTGCAGCAAAGGCAATAAGTCTCTCTCCATAACCGGCGCTGTCATGTATCCACTTTTGAGCCCAATCGGCC
TTCTTTTTTACACAAGGCATCGTTTCTATGGCATTAAAGAGATAGTTTTTTTCATTACTATCTTTAACATAAGT
ATCGATCAAAAGACTATACATTTCCGAATGAATGTTTTCAATGGCCATCTGAAATCCGTAGAAACATCTAGCC
TCGGTAATCTGTACTTCTGTACAAAATCGTTCCGCCAAATTTTCATTCACTATTCCGTCACTGGCTGCAAAAA
ACGCCAATACATGTTTTATAAAATATTTTTCGTCTGGTGTTAGTTTATTCCAATCATTGATATCTTTAGATATATC
TACTTCTTCCACTGTCCAAAATGATGCCTCTGCCTTTTTATACATGTTCCAGATGTCATAATATTGGATTGGGA
AAATAACAAATCTATTTGGATTTGGTGCAAGGATGGGTTCCATAACTAAATTAACAATATCAATAAATTTTTT
TTCAGTTATCTATATGCCTGTACTTGGATTTTTTGTACATCGATATCGCCGCAATCACTACAATAATTACAAGTA
TTATTGATAGCATTGTTATTAGTACTATCATAATTAAATTATCGACATTCATGGGTGCTGAATAATCGTTATTATC
ATCATTATCATTTTGTAATTGTGACATCATACTAAATAAATCGTTTGCGAGATTGTTGTGGGAAGCGGGCATG
GAGGATGCATTATCATTATTATTTAACGCCTTCCATTTGGATTCACAAATGTTACGCACATTCAACATTTTATG
GAAACTATAATTTTGTGAAAACAGATAACAAGAAACTCGTTATCGTTCAAATTTTTAACGATAGTAAACCG
ATTAAACGTCGAGCTAATTTCTAACGCTAGCGACTCTGTTGGATATGGGTTTCCAGATATATATCTTTTCAGT
TCCCCTACGTATCTATAATCATCTGTAGGAAATGGAAGATATTTCCATTTATCTACTGTTCCTAATATCATATGT
GGTGGTGTAGTAGAACCATTAAGCGCGAAAGATGTTATTTCGCATCGTATTTTAACTTCGCAATAATTTCTG
GTTAGATAACGCACTCTACCAGTCAAGTCAATGATATTAGCCTTTACAGATATATTCATAGTAGTCGTAACGAT
GACTCCATCTTTTAGATGCGATACTCCTTTGTATGTACCAGAATCTTCGTACCTCAAACTCGATATATTTAAAC
AAGTTAATGAGATATTAACGCGTTTTATGAATGATGATATATAACCAGAAGTTTTATCCTCGGTGGCTAGCGC
TATAACCTTATCATTATAATACCAACTAGTGTGATTAATATGTGACACGTTAGTGTGGGTACAAATATGTACATT
ATCGTCTACGTCGTATTCGATACATCCGCATACAGCCAACAAATATAAAATGACAAATACTCTAACGCCGTTC
GTACCCATCTTGATGCGGTTAATAAATGTTTTGATTTCAATTTATTGTAAAAAAGATTCGGTTTTATACTGT
TCGATATTCTCATTGCTTATATTTTCATCTATCATCTCCACACAGTCAAATCCGTGGTTAGCATGCACCTCATCA
ACCGGTAAAAGACTATCGGACTCTTCTATCATTATAACTCTAGAATATTTAATTTGGTCATTATTAATCAAGTC
AATTATCTTATTTTTAACAAACGTGAGTATTTTACTCATTTTTTATAAAAACTTTTAGAAATATACAGACTCTAT
```

FIG. 11K

CGTGTGTCTATATCTTCTTTTTATATCCAATGTATTTATGTCTGATTTTTCTTCATTTATCATATATAATGGTCCAA
ATTCTACACGTGCTTCGGATTCATCCAGATCATTAAGGTTCTTATAATTGTAACATCCTTCTCTTCCCTCTTCTA
CATCTTCCTTCTTATTCTTATTCTTAGCGTCACAGAATCTACCACAGCAGGATCCCATGACGAGCGTCATATTA
AACTAATTCATTTTCAATTATAATATACTGGTAATGACCATTAAAATAAAAATATTCTTCATAACCGGTAAGAA
AGTGAAAAGTTCACATTGAAACTATGTCAGTAGTATACATCATGAAATGAGATGAAATGATGATATATATACT
CTATTTTGGTGGAGGATTATATGATATAATTCGTGGATAATCATTTTTAAGACACATTTCTTTATTCGTAAATCT
TTTCACGTTAAATGAGTGTCCATATTTTGCAATTTCTTCATATGATGGCGGTGTACGTGGACGAGGCTGCTC
CTGTTCTTGTTGTAGTCGCCGACTGTCGTGTTTGCGTTAGATCCCTCCATTATCGCGATTGCGTAGATGGA
GTACTATTATATACCTTGTAATTAAATTTTTTTATTAATTAAACGTATAAAAACGTTCCGTATCTGTATTTAAGA
GCCAGATTTCGTCTAATAGAACAAATAGCTACAGTAAAAATAACTAGAATAATTGCTACACCCACTAGAAAC
CACGGATCGTAATACGGCAATCGGTTTTCGATAATAGGTGGAACGTATATTTTATTTAAGGACTTAACAATTG
TCTGTAAACCACAATTTGCTTCCGCGGATCCTGTATTAACTATCTGTAAAAGCATATGTTGACCGGGCGGAG
CCGAACATTCTCCGATATCTAATTTCTGTATATCTATAATATTATTAACCTCCGCATACGCATTACAGTTCTTTTC
TAGCTTGGATACCGCACTAGGTACATCGTCTAGATCTATTCCTATTTCTTCAGCGATAGCTCTTCTATCCTTTT
CCGGAAGCAATGAAATCACTTCAATAAATGATTCAACCATGAGTGTGAAACTAAGTCGAGAATTACTCATGC
ATTTGTTAGTTATTCGGAGCGCGCAATTTTTAAACTGTCCTATAACCTCTCCTATATGAATAGCACAAGTGAC
ATTAGTAGGGATAGAATGTTGAGCTAATTTTTGTAAATAACTATCTATAAAAAGATTATACAAAGTTTTAAAC
TCTTTAGTTTCCGCCATTTATCCAGTCTGAGAAAATGTCTCTCATAATAAATTTTTCCAAGAAACTAATTGGG
TGAAGAATGGAAACCTTTAATCTATATTTATCACAGTCTGTCTTGGTACACATGATGAATTCTTCTAATGCTGT
ACTAAATTCGATATCTTTTTCGATTTCTGGATATGTTTTTAATAAAGTATGAACAAAGAAATGGAAATCGTAAT
ACCAGTTATGTTTAACTTTGAAATTGTTTTTTATTTTCTTGTTAATGATTCCAGCCACTTGGGAAAAGTCAAA
GTCGTTTAATGCCGATTTAATACGTTCATTAAAAACAAACTTTTTATCCTTTAGATGAATTATTATTGGTTCATT
GGAATCAAAAAGTAAGATATTATCGGGTTTAAGATCTGCGTGTAAAAAGTTGTCGCAGCATGGTAGTTCGT
AAATTTTAATGTATAACAGAGCCATCTGTAAAAAGATAAACTTTATGTATTGTACCAAAGATTTAAATCCTAAT
TTGATAGCTAACTCGGTATCTACTTTATCTGCAGAATACAGTGCTAGGGGAAAAATTATAATATTTCCTCTTTC
GTATTCGTAGTTAGTTCTCTTTTCATGTTCGAAAAAGTGAAACATGCGGTTAAAATAGTTTATAACATTAATAT
TACTGTTAATAACTGCCGGGTAAAAGTGGGATAGTAATTTCACGAATTTGATACTGTCCTTTCTCTCGTTAAA
CGCCTTTAAAAAAACTTTAGAAGAATATCTCAATGAGAGTTCCTGACCATCCATAGTTTGTATCAATAATAGC
AACATATGAAGAACCCGTTTATACAGAGTATGTAAAAATGTTAATTTATAGTTTAATCCCATGGCCCACGCAC
ACACGATTAATTTTTTTTCATCTCCCTTTAGATTGTTGTATAGAAATTTGGGTACTGTGAACTCCGCCGTAGT
TTCCATGGGACTATATAATTTTGTGGCCTCGAATACAAATTTTACTACATAGTTATCTATCTTAAAGACTATACC
ATATCCTCCTGTAGATATGTGATAAAAATCGTCGTTTATAGGATAAAATCGTTTATCCTTTTGTTGGAAAAAG
GATGAATTAATGTAATCATTCTCTTCTATCTTTAGTAGTGTTTCCCTATTAAAATTCTTAAAATAATTTAACAAT
CTAACTGACGGAGCCCAATTTTGGTGTAAATCTAATTGGGACATTATATTGTTAAAATACAAACAGTCTCCTA
ATATAACAGTATCTGATAATCTATGGGGAGACATCCATTGATATTCAGGGGATGAATCATTGGCAACACCCAT
TTATTGTACAAAAAGCCCCAATTTACAAACGAAAGTCCAGGTTTGATAGAGACAAACTATTAACTATTTTGT
CTCTGTTTTTAATTTCTTTAGTAATGAAATTATTCACAATATCAGTATCTTCTTTATCTACCAGAGATTTTACTA
ACTTGATAACCTTGGCTGTCTCATTCAATAGGGTAGTAATATTTGTATGTGTGATATTGATATCTTTTTGAATT
GTTTCTTTTAGAAGTGATTCTTTGATGGTGCCAGCATACGAATTACAATAATGCAGAAACTCGGTTAACATG
CAGGAATTATAGTAAGCCAATTCCAATTGTTGCCTGTATTGTATTAGAGTATTAATATGCGCAATGGTGTCCTT
GCGTTTCTCTGATAGAATGCGAGCAGCGATTTTGGCGTTATCATTTGACGATATTTCTGGAATGACGAATCC
TGTTTCTACTAACTTTTTGGTAGGACAAAGTGAAACAATCAAGAAGATAGCTTCTCCTCCTATTTGTGGAAG
AAATTGAACTCCTCTAGATGATCTACTGACGATAGTATCTCCTTGACAGATATTGGACCGAATTACAGAAGTA
CCTGGAATGTAAAGCCCTGAAACCCCCTCATTTTTTAAGCAGATTGTTGCCGTAAATCCTGCACTGTGACCA

FIG. 11L

```
AGATAGAGAGCTCCTTTGGTGAATCCATCTCTATGTTTCAGTTTAACCAAGAAACAGTCAGCTGGTCTAAAA
TTTCCATCTCTATCTAATACAGCATCTAACTTGATGTCAGGAACTATGACCGGTTTAATGTTATATGTAACATT
GAGTAAATCCTTAAGTTCATAATCATCACTGTCATCAGTTATGTACGATCCAAACAATGTTTCTACCGGCATA
GTGGATACGAAGATGCTATCCATCAGAATGTTTCCCTGATTAGTATTTTCTATATAGCTATTCTTCTTTAAACG
ATTTTCCAAATCAGTAACTATGTTCATTTTTTTAGGAGTAGGACGCCTAGCCAGTATGGAAGAGGATTTTCT
AGATCCTCTCTTCAACATCTTTGATCTCAATGGAATGCAAAACCCCATAGTGAAACAACCAACGATAAAAAT
AATATTGTTTTTCACTTTTTATAATTTTACCATCTGACTCATGGATTCATTAATATCTTTATAAGAGCTACTAAC
GTATAATTCTTTATAACTGAACTGAGATATATACACCGGATCTATGGTTTCCATAATTGAGTAAATGAATGCTC
GGCAATAACTAATGGCAAATGTATAGAACAACGAAATTATACTAGAGTTGTTAAAGTTAATATTTTCTATGAG
CTGTTCCAATAAATTATTTGTTGTGACTGCGTTCAAGTCATAAATCATCTTGATACTATCCAGTAAACAGTCTT
TAAGTTCTGGAATATTATCATCCCATTGTAAAGCCCCTAATTCGACTATCGAATATCCTGCTCTGATAGCAGTT
TCAATATCGACGGACGTCAATACTGTAATAAAGGTGGTAGTATTGTCATCATCGTGATAAACTACTGGAATAT
GGTCGTTAGTAGGTACGGTAACTTTACACAACGCGATATATAACTTTCCTTTTGTACCATTTTTAACGTAGTT
GGGACGTCCTGCAGGGTATTGTTTTGAAGAAATGATATCGAGAACAGATTTGATACGATATTTGTTGGATTC
CTGATTATTTACTATAATATAATCTAGACAGATAGATGATTCGATAAATAGAAAAGGTATATCGTTGGTAGGAT
AATACATCCCCATTCCAGTATTCTCGGATACTCTATTAATGACACTAGTTAAGAACATGTCTTCTATTCTAGAA
AACGAAAACATCCTACATGGACTCATTAAAACTTCTAACGCTCCTGATTGTGTCTCGAATGCCTCGTACAAG
GATTTCAAGGATGCCATAGATTCTTTGACCAACGATTTAGAATTGCGTTTAGCATCTGATTTTTTTATTAAAT
CGAATGGTCGGCTCTCTGGTTTGCTACCCCAATGATAACAATAGTCTTGTAAAGATAAACCGCAAGAAAATT
TATACGCATCCATCCAAATAACCCTAGCACCATCGGATGATATTAATGTATTATTATAGATTTTCCATCCACAGT
TATTGGGCCAGTATACTGTTAGCAACGGTATATCGAATAGATTACTCATGTAACCTACTAGAATGATAGTTCGT
GTACTAGTCATAATATCTTTAATCCAATCTAAGAAATATAAAATTAGATCTTTTACACTGTTAAAGTTAACAAA
GGTATTACCCGGATACGTGGATATCATATATGGCATTGGTCCATTATCAGTAATAGCTCCATAAACTGATACGG
CGATGGTTTTTATATGTGTTTGATCTAACGAGGAAGAAATTCGCGCCCACAATTCATCTCTAGATATGTATTT
AATATCAAACGGTAACACATCAATTTCGGGACGCGTATATGTTTCTAAATTTTTAATCCAAATATAATGATGAC
CTATATGCCCTATTATCATACTGTCAACTATAGTACACCTAGAGAACTTACGATACATCTGTTTCCTGTAATCGT
TAAATTTTACAAATCTATAACATGCTAAACCTTTTGACGACAACCATTCATTAATTTCTGATATGGAATCTGTA
TTCTCGATACCGTATTGTTCTAAAGCCAGTGCTATATCTCCCTGTTCGTGGGAACGCTTTCGTATAATATCGAT
CAACGGATAATCTGAAGTTTTTGGAGAATAATATGACTCATGATCTATTTCGTCCATAAACAATCTAGACATA
GGAATTGGAGGCGATGATCTTAATTTTGTGCAATGAGTCGTCAATCCTATAACTTCTAATCTTGTAATATTCAT
CATCGACATAATACTATCTATGTTATCATCGTATATTAGTATACCATGACCTTCTTCATTTCGTGCCAAAATGATA
TACAGTCTTAAATAGTTACGCAATATCTCAATAGTTTCATAATTGTTAGCTGTTTTCATCAAGATTTGTACCCT
GTTTAACATGATGGCGTTCTATACGTTTCTATTTTCTATTTTTTAAATTTTTAACGATTTACTGTGGCTAGATAC
CCAATCTCTCTCAAATATTTTTTTAGCCTCGCTTACAAGCTGTTTATCTATACTATTAAAACTGACGAATCCGT
GATTTTGGTAATGGGTTCCGTCGAAATTTGCCGAAGTGATATGAACATATTCGTCGTCGACTATCAACAATTT
TGTATTATTCTGAATAGTGAAAACCTTCACAGATAGATCATTTTGAACACACAACGCGTCTAGACTTCTGGC
GGTTGCCATAGAATATACGTCGTTCTTATCCCAATTACCAACTAGAAGTCTGATCTTAACTCCTCTATTAATGG
CTGCTTCTATAATGGAGTTGTAAATGTCGGGCCAATAGTAGCTATTACCGTCGACACGTGTAGTGGGAACTA
TGGCCAAATGTTCAATATCTATACTAGTCTTAGCTGACCTGAGTTTATCAATAACTACATCGGTATCTAGATCT
CTAGAATATCCCAATAGGTGTTCCGGAGAATCAGTAAAGAACACTCCACCTATAGGATTCTTAATATGATACG
CAGTGCTAACTGGCAGACAACAAGCCGCAGAGCATAAATTCAACCATGAATTTTTTGCGCTATTAAAGGCT
TTAAAAGTATCAAATCTTCTACGAAGATCTGTGGCCAGCGGGGGATAATCAGAATATACACCTAACGTTTTA
ATCGTATGTATAGATCCTCCAGTAAATGACGCGTTTCCTACATAACATCTTTCATCATCTGACACCCAAAAACA
ACCGAGTAGTAGTCCCACATTATTTTTTTTATCTATATTAACGGTTATAAAATTTATATCCGGGCAGTGACTTT
```

FIG. 11M

GTAGCTCTCCCAGATTTCTTTTCCCTCGTTCATCTAGCAAAACTATTATTTTAATCCCTTTTTCAGATGCCTCTT
TTAGTTTATCAAAAATAAGCGCTCCCCTAGTCGTACTCAGAGGATTACAACAAAAAGATGCTATGTATATATA
TTTCTTAGCTAGAGTGATAATTTCGTTAAAACATTCAAATGTTGTTAAATGATCGGATCTAAAATCCATATTTT
CTGGTAGTGTTTCTACCAGCCTACATTTTGCTCCCGCAGGTACCGATGCAAATGGCCACATTTAGTTAACATA
AAAACTTATACATCCTGTTCTATCAACGATTCTAGAATATCATCGGCTATATCGCTAAAATTTTCATCAAAGTC
GACATCACAACCTAACTCAGTCAATATATTAAGAAGTTCCATGATGTCATCTTCGTTTATTTCTATATCCGTATC
CATTGTAGATTGTTGACCGATTATCGAGTTTAAATCATTACTAATACTCAATCCTTCAGAATACAATCTGTGTT
TCATTGTAAATTTATAGGCGGTGTATTTAAGTTGGTAGATTTTCAATTATGTATCAATATAGCAACAGTAGTTC
TTGCTCCTCCTTGATTCTAGCATCCTCTTCATTATTTTCTTCTACGTACATAAACATGTCCAATACGTTAGACAA
CACACCGACGATGGCGGCCGCCACAGACACGAATATGACTAAACCGATGACCATTTAAAAACCCCTCTCTA
GCTTTCACTTAAACTGTATCGATTATTCTTTTAGAACATGTATAATATAAAAACATTATTCTATTTCGAATTTAG
GCTTCCAAAAATTTTTCATCCGTAAACCGATAATAATATATATAGACTTGTTAATAGTCGGAATAAATAGATTA
ATGCTTAAACTATCATCATCTCCACGATTAGAGATACAATATTTACATTCTTTTTGCTGTTTCGAAACTTTATCA
ATACACGTTAATACAAACCCAGGAAGGAGATATTGAAACTGAGGCTGTTGAAAATGAAACGGTGAATACA
ATAATTCAGATAATGTAAAATCATGATTCCGTATTCTGATGATATTAGAACTGCTAATGGATGTCGATGGTATG
TATCTAGGAGTATCTATTTTAACAAAGCATCGATTTGCTAATATACAATTATCCTTTTGATTAATTGTTATTTTAT
TCATATTCTTAAAAGGTTTCATATTTATCAATTCTTCTACATTAAAAATTTCCATTTTTAATTTATGTAGCCCCGC
AATACTCCTCATTACGTTTCATTTTTTGTCTATAATATCCATTTTGTTCATCTCGGTACATAGATTATCCAATTGA
GAAGCGCATTTAGTAGTTTTGTACATTTTAAGTTTATTGACAAATCGTCGAAAACTAGTTATAGTTAACATTT
TATTATTTGATACCCTGATATTAATACCCCTGCCGTTACTATTATTTATAACTGATGTAATCCACGTAACATTAGA
ATTAATTATCGATAGTAATGCATCGACGCTTCCAAAATTGTCTATTATAAACTCACCGATAATTTTTTTATTGCA
TGTTTTCATATTCATTAGGATTATCAAATCTTTAATCTTATTACGATTGTATGCGTTGATATTGCAAGACGTCAT
TCTAAAAGACGGAGGATCTCCATCAAATGCCAAACAATCACGTACAAAGTACATGGAAATAGGTTTTGTTC
TATTGCGCATCATAGATTTATATAGAACACCCGTAGAAATACTAATTTGTTTTACTCTATAAAATACTAATGCAT
CTATTTCATCGTTTTGTATAACGTCTTTCCAAGTGTCAAATTCCAAATTTTTTTCATTGATAGTACCAAATTCTT
CTATCTCTTTAACTACTTGCATAGATAGGTAATTACAGTGATGCCTACATGCCGTTTTTTGAAACTGAATAGAT
GCGTCTAGAAGCGATGCTACGCTAGTCACAATCACCACTTTCATATTTAGAATATATGTATGTAAAAATATAGT
AGAATTTCATTTTGTTTTTTTCTATGCTATAAATGAATTCTCATTTTGCATCTGCTCATACTCCGTTTTATATCAA
TACCAAAGAAGGAAGATATTTGGTTCTAAAAGCCGTTAAAGTATGCGATGTTAGAACTGTAGAATGTGAAG
GAAGTAAAGCTTCCTGCGTACTCAAAGTAGATAAACCCTCATCACCCGCGTGTGAGAGAAGACCTTCGTCC
CCTTCCAGATGCGAGAGAATGAATAACCCAGGAAAACAAGTTCCGTTTATGAGGACGGACATGCTACAAA
ATATGTTCGCGGCTAATCGCGATAATGTAGCTTCTAGACTTTTGTCCTAAAATACTATTATATCCTTTTCGATAT
TAATAAATCCGTGTCGTCCAGGTTTTTTATCTCTTTCAGTATGTGAATAGATAGGTATTTTATCTCTATTCATCA
TCGAATTTAAGAGATCCGATAAACATTGTTTGTATTCTCCAGATGTCAGCATCTGATACAACAATATATGTGC
ACATAAACCTCTGGCACTTATTTCATGTACCTTCCCCTTATCACTAAGGAGAATAGTATTTGAGAAATATGTAT
ACATGATATTATCATGAATTAGATATACAGAATTTGTAACACTCTCGAAATCACACGATGTGTCGGCGTTAAG
ATCTAATATATCACTCGATAACACATTTTCATCTAGATACACTAGACATTTTTTAAAGCTAAAATAGTCTTTAGT
AGTGACAGTAACTATGCGATTATTTTCATCGATGATACATTTCATCGGCATATTATTACGCTTACCATCAAAGA
CTATACCATGTGTATATCTAACGTATTCTAGCATGGTTGCCATACGCGCATTAAACTTTTCAGGATCTTTGGAT
AGATCTTCCAATCTATCTATTTGAGAAAACATTTTTATCATGTTCAATAGTTGAAACGTCGGATCCACTATATA
GATATTATCTATAAAGATTTTAGGAACTACGTTCATGGTATCCTGGCGAATATTAAAACTATCAATGATATGAT
TATCGTTTTCATCTTTTATCACCATATAGTTTCTAAGATATGGGATTTTACTTAATATAATATTATTTCCCGTGAT
AAATTTTATTAGAAAGGCCAAATCTATAAGAAAAGTCCTAGAATTAGTCTGAAGAATATCTATATCGCCGTAT
AGTATATTTGGATTAATTAGATATAGAGAATATGATCCGTAACATATACAACTTTTATTATGGCGTCTAAGATAT

FIG. 11N

TCTTCCATCAACTTATTAACATTTTTGACTAGGGAAGATACATTATGACGTCCCATTACTTTTGCCTTGTCTAT
TACTGCGACGTTCATAGAATTTAGCATATCTCTTGCCAATTCTTCCATTGATGTTACATTATAAGAAATTTTAG
ATGAAATTACATTTGGAGCTTTAATAGTAAGAACTCCTAATATGTCCGTGTATGTGGTCACTAATACAGATTG
TAGTTCTATAATCGTAAATAATTTACCTATATTATATGTTTGAGTCTGTTTAGAAAAGTAGCTAAGTATACGATC
TTTTATTTCTGATGCAGATGTATTAACATCGGAAAAAAATCTTTTTTTATTCTTTTTTACTAAAGATACAAATAT
GTCTTTGTTAAAAACAGTTATTTTTTGAATATTTCTAGCTTGTAATTTTAACATATGATATTCGTTCACACTAG
GTACTCTGCCTAAATAGGTTTCTATAATCTTTAATGTAATATTAGGAAAAGTATTCTGATCAGGATTCCTATTC
ATTTTGAGGATTTAAAACTCTGATTATTGTCTAATATGGTCTCTACGCAAACTTTTTCACAGAGCGATAGAGT
TTTTGATAACTCGTTTTTCTTAAGAAATATAAAACTACTGTCTCCAGAGCTCGCTCTATCTTTTATTTTATCTAA
TTCGATACAAACTCCTGATACTGGTTCAGAAAGTAATTCATTAATTTTCAGTCCTTTATAGAAGATATTTAATA
TAGATAATACAAAATCTTCAGTTTTTGATATCGATCTGATTGATCCTAGAACTAGATATATTAATAACGTGCTC
ATTAGGCAGTTTATGGCAGCTTGATAATTAGATATAGTATATTCCAGTTCATATTTATTAGATACCGCATTGCCC
AGATTTTGATATTCTATGAATTCCTCTGAAAATAAATCCAAAATAACTAGACATTCTATTTTTTGTGGATTAGT
GTACTCTCTTCCCTCTATCATGTTCACTACTGGTGTCCACGATGATAAATATCTAGAGGGAATATAATATAGTC
CATAGGATGCCAATCTAGCAATGTCGAATAACTGTAATTTTATTCTTCGCTCTTCATTATGAATTGATTCTTGA
GGTATAAACCTAACACAAATTATATTATTAGACTTTTCGTATGTAATGTCTTTCATGTTATAAGTTTTTAATCCT
GGAATAGAATCTATTTTAATGAGGCTTTTAAACGCAGAGTTCTCCAACGAGTCAAAGCATAATACTCTGTTG
TTTTTCTTATATACGATGTTACGATTTTCTTCTTTGAATGGAATAGGTTTTTGAATTAGTTTATAATTACAACAT
AATAGATAAGGAAGTGTGCAAATAGTACGCGGAAAAAACATAATAGCTCCCCTGTTTTCATCCATGGTTTTA
AGTAAATGATCACTGGCTTCTTTAGTCAATGGATATTCGAACATTAACCGTTTCATCATCATTGGACAGAATC
CATATTTTTTAATGTAAAGAGTGATCAAATCATTGTGTTTATTGTACCATCTTGTTGTAAATGTGTATTCGGTT
ATCGGATCTGCTCCTTTTTCTATTAAAGTATCGATGTCGATCTCGTCTAAGAATTCAACTATATCGACATATTTC
ATTTGTATACACATAACCATTACTAACGTAGAATGTATAGGAAGAGATGTAACGGGAACAGGGTTTGTTGAT
TCGCAAACTATTCTAATACATAATTCTTCTGTTAATACGTCTTGCACGTAATCTATTATAGATGCCAAGATATCT
ATATAATTATTTTGTAAGATGATGTTAACTATGTGATCTATATAAGTAGTGTAATAATTCATGTATTTTGATATAT
GTTCCAACTCTGTCTTTGTGATGTCTAGTTTCGTAATATCTATAGCATCCTCAAAAAATATATTCGCATATATTC
CCAAGTCTTCAGTTCTATCTTCTAAAAAATCTTCAACGTATGGAATATAATAATCTATTTTACCTCTTCTGATAT
CATTAATGATATAGTTTTTGACACTATCTTCTGTCAATTGATTCTTATTCACTATATCTAAGAAACGGATAGCGT
CCCTAGGACGAACTACTGCCATTAATATCTCTATTATAGCTTCTGGACATAATTCATCTATTATACCAGAATTAA
TGGGAACTATTCCGTATCTATCTAACATAGTTTTAAGAAAGTCAGAATCTAAGACTTGATGTTCATATATTGGT
TCATACATGAAATGATCTCTATTGATGATAGTGACTATTTCATTCTCTGAAAATTGGTAACTCATTCTATATATG
CTTTCCTTGTTGATGAAGGATAGAATATACTCAATAGAATTTGTACCAACAAACTGTTCTCTTATGAATCGTAT
ATCATCATCTGAAATAATCATGTAAGGCATACATTTAACAATTAGAGACTTGTCTCCTGTTATCAATATACTATT
CTTGTGATAATTTATGTGTGAGGCAAATTTGTCCACGTTCTTTAATTTTGTTATAGTAGATATCAAATCCAATG
GAGCTACAGTTCTTGGCTTAAACAGATATAGTTTTTCTGGAACGAATTCTACAACATTATTATAAAGGACTTT
GGGTAGATAAGTGGGATGAAATCCTATTTTAATTAATGCGATAGCCTTGTCCTCGTGCAGATATCCAAACGC
TTTTGTGATAGTATGGCATTCATTGTCTAGAAACGCTCTACGAATATCTGTGACAGATATCATCTTTAGAGAAT
ATACTAGTCGCGTTAATAGTACTACAATTTGTATTTTTTAATCTATCTCAATAAAAAAATTAATATGTATGATTC
AATGTATAACTAAACTACTAACTGTTATTGATAACTAGAATCAGAATCTAATGATGACGTAACCAAGAAGTTT
ATCTACTGCCAATTTAGCTGCATTATTTTTAGCATCTCGTTTAGATTTTCCATCTGCCTTATCGAATACTCTTCC
GTCGATATCTACACAGGCATAAAATGTAGGAGAGTTACTAGGCCCCACTGATTCAATACGAAAAGACCAATC
TCTCTTAGTTATTTGGCAGTACTCATTAATAATGGTGACAGGGTTAGCATCTTTCCAATCAATAATTTTTTTAG
CCGGAATAACATCATCAAAAGACTTATGATCCTCTCTCATTGATTTTTCGCGGGATACATCATCTATTATGGCG
TCAGCCATAACATCAGCATCCGGCTTATCCGCCTCCGTTGTCATAAACCAACGAGGAGGAATATCGTCGGA

FIG. 11O

GCTGTACACCATAGCACTACGTTGAAGATCGTACAGAGCTTTATTAACTTCTCGCTTCTCCATATTAAGTTGT
CTAGTTAGTTGTGCAGCAGTAGCTCCTTCGATTCCAATGTTTTTAATAGCCGCACACACAATCTCTGCGTCA
GAACGCTCGTCAATATAGATCTTAGACATTTTTAGAGAGAACTAACACAACCAGCAATAAAACTAATTTATTT
TATCATTTTTTTATTCATCATCCTCTGGTGGTTCGTCGTTTCTATCGAATGTGGATCTGATTAACCCGTCATCTA
TAGGTGATGCTGGTTCTGGAGATTCTGGAGGAGATGGATTATTATCTGGAAGAATCTCTGTTATTTCCTTGT
TTTCATGTATCGATTGCGTTGTAACATTAAGATTGCGAAATGCTCTAAATTTGGGAGGCTTAAAGTGTTGTTT
GCAATCTCTACACGCATGTCTAACTAGTGGAGGTTCGTCAGCGGCTCTAGTTTGAATCATCATCGGCGTAGT
ATTCCTACTTTTACAGTTAGGACACGGTGTATTGTATTTCTCGTCGAGAACGTTAAAATAATCGTTGTAACTC
ACATCCTTTATTTTATCTATATTGTATTCTACTCCTTTCTTAATGCATTTTATACCGAATAAGAGATAGCGAAGG
AATTCTTTTTCGGTGCCGCTAGTACCCTTAATCATATCACATAGTGTTTTATATTCCAAATTTGTGGCAATAGA
CGGTTTATTTCTATACGATAGTTTGTTTCTGGAATCCTTTGAGTATTCTATACCAATATTATTCTTTGATTCGAA
TTTAGTTTCTTCGATATTAGATTTTGTATTACCTATATTCTTGATGTAGTACTTTGATGATTTTTCCATGGCCCAT
TCTATTAAGTCTTCCAAGTTGGCATCATCCACATATTGTGATAGTAATTCTCGGATATCAGTAGCGGCTACCGC
CATTGATGTTTGTTCATTGGATGAGTAACTACTAATGTATACATTTTCCATTTATAACACTTATGTATTAACTTT
GTTCATTTATATTTTTTCATTATTATGTTGATATTAACAAAAGTGAATATATATATATGTTAATAATTGTATTGTGG
TTATACGGCTACAATTTTATAATGAGTGAAAGTCAGTGTCCGATGATCAATGACGATAGCTTTACTCTGAAAA
GAAAGTATCAAATCGATAGTGCGGAGTCAACAATAAAAATGGATAAGAAGAGGATAAAGTTTCAGAATAG
AGCCAAAATGGTAAAAGAAATAAATCAGACAATAAGAGCAGCACAAACTCATTACGAGACATTGAAACTA
GGATACATAAAATTTAAGAGAATGATTAGGACTACTACTCTAGAAGATATAGCACCATCTATTCCAAATAATC
AGAAAACTTATAAACTATTCTCGGACATTTCAGCCATCGGCAAAGCATCACAGAATCCGAGTAAGATGGTAT
ATGCTCTGCTGCTTTACATGTTTCCCAATTTGTTTGGAGATGATCATAGATTCATTCGTTATAGAATGCATCCA
ATGAGTAAAATCAAACACAAGATCTTCTCTCCTTTCAAACTTAATCTTATTAGAATATTAGTGGAAGAAAGAT
TCTATAATAATGAATGCAGATCTAATAAATGGAAAATAATTGGAACACAAGTTGATAAAATGTTGATAGCTGA
ATCTGATAAATATACAATAGATGCAAGGTATAACCTAAAACCCATGTATAGAATCAAGGGAGAATCTGAAGA
AGATACCCTCTTTATCAAACAGATGGTAGAACAATGTGTGACATCCCAGGAATTGGTGGAAAAAGTGTTGA
AGATACTGTTTAGAGATTTGTTCAAGAGTGGAGAATACAAAGCGTACAGATACGATGATGATGTAGAAAAT
GGATTTATTGGATTGGATACACTAAAATTAAACATTGTTCATGATATAGTTGAACCATGTATGCCTGTTCGTA
GGCCAGTGGCTAAGATACTGTGTAAAGAAATGGTAAATAAATACTTTGAGAATCCGCTACATATTATTGGTA
AAAATCTTCAAGAGTGCATTGACTTTGTTAGTGAATAGGCATTTCATCTTTCTCCAATACTAATTCAAATTGT
TAAATTAATAATGGATAGTATAAATAGTTATTAGTGATAAAATAGTAAAAATAATTATTAGAATAAGAGTGTAG
TATCATAGATAACTCTCTTCTATAAAAATGGATTTTATTCGTAGAAAGTATCTTATATACACAGTAGAAAATAAT
ATAGATTTTTTAAAGGATGATACATTAAGTAAAGTAAACAATTTTACCCTCAATCATGTACTAGCTCTCAAGT
ATCTAGTTAGCAATTTTCCTCAACACGTTATTACTAAGGATGTATTAGCTAATACCAATTTTTTTGTTTTCATAC
ATATGGTACGATGTTGTAAAGTGTACGAAGCGGTTTTACGACACGCATTTGATGCACCCACGTTGTACGTTA
AAGCATTGACTAAGAATTATTTATCGTTTAGTAACGCAATACAATCGTACAAGGAAACCGTGCATAAACTAA
CACAAGATGAAAAATTTTTAGAGGTTGCCGAATACATGGACGAATTAGGAGAACTTATAGGCGTAAATTAT
GACTTAGTTCTTAATCCATTATTTCACGGAGGGGAACCCATCAAAGATATGGAAATCATTTTTTTAAAACTGT
TTAAGAAAACAGACTTCAAAGTTGTTAAAAAATTAAGTGTTATAAGATTACTTATTTGGGCATACCTAAGCA
AGAAAGATACAGGCATAGAGTTTGCGGATAATGATAGACAAGATATATATACTCTATTTCAACAAACTGGTA
GAATCGTCCATAGCAATCTAACAGAAACGTTTAGAGATTATATCTTTCCCGGAGATAAGACTAGCTATTGGG
TGTGGTTAAACGAAAGTATAGCTAATGATGCGGATATCGTTCTTAATAGACACGCCATTACCATGTATGATAA
AATTCTTAGTTATATATACTCTGAGATAAAACAGGGACGCGTTAATAAAAACATGCTTAAGTTAGTTTATATCT
TTGAGCCTGAAAAAGATATCAGAGAACTTCTGCTAGAAATCATATATGATATTCCTGGAGATATCCTATCTATT
ATTGATGCAAAAAACGACGATTGGAAAAAATATTTTATTAGTTTTTATAAAGCTAATTTTATTAACGGTAATA

FIG. 11P

```
CATTTATTAGTGATAGAACGTTTAACGAGGACTTATTCAGAGTTGTTGTTCAAATAGATCCCGAATATTTCGA
TAATGAACGAATTATGTCTTTATTCTCTACGAGTGCTGCGGACATTAAACGATTTGATGAGTTAGATATTAATA
ACAGTTATATATCTAATATAATTTATGAGGTGAACGATATCACATTAGATACAATGGATGATATGAAGAAGTGT
CAAATCTTTAACGAGGATACGTCGTATTATGTTAAGGAATACAATACATACCTGTTTTTGCACGAGTCGGATC
CCATGGTCATAGAGAACGGAATACTAAAGAAACTGTCATCTATAAAATCCAAGAGTAGACGGCTGAACTTG
TTTAGCAAAAACATTTTAAAATATTATTTAGACGGACAATTGGCTCGTCTAGGTCTTGTGTTAGATGATTATA
AAGGAGACTTGTTAGTTAAAATGATAAACCATCTTAAGTCTGTGGAGGATGTATCCGCATTCGTTCGATTTT
CTACAGATAAAAACCCTAGTATTCTTCCATCGCTAATCAAAACTATTTTAGCTAGTTATAATATTTCCATCATCG
TCTTATTTCAAAGGTTTTTAAGAGATAATCTATATCATGTAGAAGAATTCTTGGATAAAAGCATCCATCTAACC
AAGACGGATAAGAAATATATACTTCAATTGATAAGACACGGTAGATCATAGAACAGACCAAATATATTATTAA
TAATTTGTATATACATAGATATAATTATCACATATTAAAAATTCACACATTTTTGATAAATGGGAACTGCTGCAA
CAATTCAGACTCCCACCAAATTAATGAATAAAGAAAATGCAGAAATGATTTTGGAAAAAATTGTTGATCATA
TAGTTATGTATATTAGTGACGAATCAAGTGATTCAGAAAATAATCCTGAATATATTGATTTTCGTAACAGATAC
GAAGACTATAGATCTCTCATTATAAAAAGTGATCACGAGTTTGTAAAGCTATGTAAAAATCATGCAGAGAAA
AGTTCTCCAGAAACGCAACAAATGATTATCAAACACATATACGAACAATATCTTATTCCAGTATCTGAAGTAC
TATTAAAACCTATAATGTCCATGGGTGACATAATTACATATAACGGATGTAAAGACAATGAATGGATGCTAGA
ACAACTCTCTACCCTAAACTTTAACAATCTCCGCACATGGAACTCATGTAGCATAGGCAATGTAACGCGTCT
GTTTTATACATTTTTTAGTTATCTGATGAAAGATAAACTAAATATATAAGTATAATCCCATTCTAATACTTTAACC
TGATGTATTAGCATCTTATTAGAATATTAACCTAACTAAAAGACATAACATAAAAACTCATTACATAGTTGATA
AAAAGCGGTAGGATATAAATATTATGGCTGCCACCGTTCCGCGTTTTGACGACGTGTACAAAAATGCACAA
AGAAGAATTCTAGATCAAGAAACATTTTTTAGTAGAGGTCTAAGTAGACCGTTAATGAAAAACACATATCTA
TTTGATAATTACGCGTATGGATGGATACCAGAAACTGCAATTTGGAGTAGTAGATACGCAAACTTAGATGCA
AGTGACTATTATCCCATTTCGTTGGGATTACTTAAAAAGTTCGAGTTTCTCATGTCTCTATATAAAGGTCCTAT
TCCAGTATACGAAGAAAAGTAAATACTGAATTCATTGCTAATGGATCGTTCTCTGGTAGATACGTATCATAT
CTTCGAAAGTTTTCTGCTCTTCCAACAAACGAGTTTATTAGTTTTTTGTTACTGACTTCCATTCCAATCTATAA
TATCTTGTTCTGGTTTAAAAATACTCAGTTTGATATTACTAAACACACATTATTCAGATACGTCTATACAGATA
ATGCCAAACACCTGGCGTTGGCTAGGTATATGCATCAAACAGGAGACTATAAGCCTTTGTTTAGTCGTCTCA
AAGAGAATTATATATTTACCGGTCCCGTTCCAATAGGTATCAAAGATATAAATCACCCTAATCTTAGTAGAGC
AAGAAGTCCATCCGATTATGAGACATTAGCTAATATTAGTACTATATTGTACTTTACCAAGTATGATCCGGTAT
TAATGTTTTTATTGTTTACGTACCTGGGTATTCAATTACTACAAAAATTACTCCAGCCGTAGAATATCTAATG
GATAAACTGAATCTAACAAAGAGCGACGTACAACTGTTGTAAATTATTTTATGCTTCGTAAAATGTAGGTTTT
GAACCAAACATTCTTTCAAAGAATGAGATGCATAAAACTTTATTATCCAATAGATTGACTATTTCGGACGTCA
ATCGTTTAAAGTAAACTTCGTAAAATATTCTTTGATCACTGCCGAGTTTAAAACTTCTATCGATAATTGTTTCA
TATGTTTTAATATTTACAAGTTTTTTGGTCCATGGTACATTAGCCGGACAAATATATGCAAAATAATATCGTTC
TCCAAGTTCTATAGTTTCTGGATTATTTTTATTATATTCAGTAACCAAATACATATTAGGGTTATCTGCGGATTT
ATAATTTGAGTGATGCATTCGACTCAACATAAATAATTCTAGAGGAGACGATCTACTATCAAATTCGGATCGT
AAATCTGTTTCTAAAGAACGGAGAATATCTATACATACCTGATTAGAATTCATCCGTCCTTCAGACAACATCT
CAGACAGTCTGGTCTTGTATGTCTTAATCATATTCTTATGAAACTTGGAAACATCTCTTCTAGTTTCACTAGTA
CCTTTATTAATTCTCTCAGGTACAGATTTTGAATTCGACGATGCCGAGTATTTCATCGTTGTATATTTCTTCTTC
GATTGCATAATCAGATTCTTATATACCGCCTCAAACTCTATTTAAAATTATTAAACAATACTCTATTATTAATCA
GTCGTTCTAACTCCTTTGCTATTTCTATGGACTTATCTACATCTTGACTGTCTATCTCTGTAAACACGGAGTCG
GTATCTCCATACACGCTACGAAAACGAAATCTGTAATCTATAGGCAACGATGTTTTCACAATCGGATTAATAT
CTCTATCGTCCATATAAAATGGATTACTTAATGGATTGGCAAACCGTAACATACCGTTAGATAACTCTGCTCCA
TTTAGTACCGATTCTAGATACAAGATCATTCTACGTCCTATGGATGTGCAACTCTTAGCCGAAGCGTATGAGT
```

FIG. 11Q

ATAGAGCACTATTTCTAAATCCCATCAGACCATATACTGAGTTGGCTACTATCTTGTACGTATATTGCATGGAA
TCATAGATGGCCTTTTCAGTTGAACTGGTAGCCTGTTTTAACATCTTTTTATATCTGGCTCTCTCTGCCAAAA
ATGTTCTTAATAGTCTAGGAATGGTTCCTTCTATCGATCTATCGAAAATTGCTATTTCAGAGATGAGGTTCGG
TAGTCTAGGTTCACAATGAACCGTAATATATCTAGGAGGTGGATATTTCTGAAGCAAGAGCTGATTATTTATT
TCTTCTTCCAATCTATTGGTACTAACAACGACACCGACTAATGTTTCCGGAGATAGATTTCCAAAGATACACA
CATTAGGATACAGACTGTTATAATCAAAGATTAATACATTATTACTAAACATTTTTTGTTTTGGAGCAAATACC
TTACCGCCTTCATAAGGAAACTTTTGTTTTGTTTCTGATCTAACTAAGATAGTTTTAGTTTCCAACAATAGCT
TTAACAGTGGACCCTTGATGACTGTACTCGCTCTATATTCGAATACCATGGATTGAGGAAGCACATATGTTG
ACGCACCCGCGTCTGTTTTTGTTTCTACTCCATAATACTCCCACAAATACTGACACAAACAAGCATCATGAAT
ACAGTATCTAGCCATATCTAAAGCTATGTTTAGATTATAATCCTTATACATCTGAGCTAAATCAACGTCATCCTT
TCCGAAAGATAATTTATATGTATCATTAGGTAAAGTAGGACATAATAGTACGACTTTAAATCCATTTTCCCAAA
TATCTTTACGAATTACTTTACATATAATATCCTCATCAACAGTCACATAATTACCTGTGGTTAAAACCTTTGCAA
ATGCAGCGGCTTTGCCTTTCGCGTCCGTAGTATCGTCACCGATGAACGTCATTTCTCTAACTCCTCTATTTAA
TACTTTACCCATGCAACTGAACGCGTTCTTGGATATAGAATCCAATTTGTACGAATCCAATTTTTCAGATTTT
TGAATGAATGAATATAGATCGAAAAATATAGTTCCATTATTGTTATTAACGTGAAACGTAGTATTGGCCATGC
CGCCTACTCCCTTATGACTAGACTGATTTCTCTCATAAATACAGAGATGTACAGCTTCCTTTTTGTCCGGAGA
TCTAAAGATAATCTTCTCTCCTGTTAATAACTCTAGACGATTAGTAATATATCTCAGATCAAAGTTATGTCCGTT
AAAGGTAACGACATAGTCGAACGTTAGTTCCAACAATTGTTTAGCTATTCGTAACAAAACTATTTCAGAACA
TAAAACTAGTTCTCGTTCGTAATCCATTTCCATTAGTGACTGTATCCTCAAACATCCTCTATCGACGGCTTCTT
GTATTTCCTGTTCCGTTAACATCTCTTCATTAATGAGCGTAAACAATAATCGTTTACCACTTAAATCGATATAA
CAGTAACTTGTATGCGAGATTGGGTTAATAAATACAGAAGGAAACTTCTTATCGAAGTGACACTCTATATCT
AGAAATAAGTACGATCTTGGGATATCGAATCTAGGTATTTTTTTAGCGAAACAGTTACGTGGATCGTCACAA
TGATAACATCCATTGTTAATCTTTGTCAAATATTGCTCGTCCAACGAGTAACATCCGTCTGGAGATATCCCGTT
AGAAATATAAAACCAACTAATATTGAGAAATTCATCCATGGTGGCATTTTGTATGCTGCGTTTCTTTGGCTCT
TCTATCAACCACATATCTGCGACGGAGCATTTTCTATCTTTAATATCTAGATTATAACTTATTGTCTCGTCAATG
TCTATAGTTCTCATCTTTCCCAACGGCCTCGCATTAAATGGAGGAGGAGACAATGACTGATATATTTCGTCCG
TCACTACGTAATAAAAGTAATGAGGAAATCGTATAAATACGGTCTCACCATTTCGACATCTGGATTTCAGATA
TAAAAATCTGTTTTCACCGTGACTTTCAAACCAATTAATGCACCGAACATCCATTTATAGAATTTAGAAATAT
ATTTTCATTTAAATGAATCCCAAACATTGGGGAAGAGCCGTATGGACCATTATTTTTATAGTACTTTCGCAAG
CGGGTTTAGACGGCAACATAGAAGCGTGTAAACGAAAACTATATACTATAGTTAGCACTCTTCCATGTCCTG
CATGTAGACGGCACGCGACTATCGCTATAGAGGACAATAATGTCATGTCTAGCGATGATCTGAATTATATTTA
TTATTTTTTCATCAGATTATTTAACAATTTGGCATCTGATCCCAAATACGCGATCGATGTGACAAAGGTTAAC
CCTTTATAAACTTAACCCATTATAAAACTTATGATTAGTCACGACTGAAATAACCGCGTGATTATTTTTGGTA
TAATTCTACACGGCATGGTTTCTGTGACTATGAATTCAACCCCCGTTACATTAGTGAAATCTTTAACAAACAG
CAAGGGTTCGTCAAAGACATAAAACTCATTGTTTACAATCGAAATAGACCCCCTATCACACTTAAAATAAAA
AATATCCTTATCCTTTACCACCAAATAAAATTCTGATTGGTCAATGTGAATGTATTCACTTAACAGTTCCACAA
ATTTATTTATTAACTCCGAGGCACATACATCGTCGGTATTTTTTATGGCAAACTTTACTCTTCCAGCATCCGTT
TCTAAAAAAATATTAACGAGTTCCATTTATATCATCCAATATTATTGAAATGACGTTGATGGACAAATGATACA
AATAAGAAGGTACGGTACCTTTGTCCACCATCTCCTCCAATTCATGCTCTATTTTGTCATTAACTTTAATGTAT
GAAAACAGTACGCCACATGCTTCCATGACAGTGTGTAACACTTTGGATACAAAATGTTTGACATTAGTATAA
TTGTTCAAGACTGTCAATCTATAATAGATAGTAGCTATAATATATTCTATGATGGTATTGAAGAAGATGACAAC
CTTGGCATATTGATCATTTAACACAGACATGGTATCAACAGATAGCTTGAATGAAAGAGAATCAGTAATTGG
AATAAGCGTCTTCTCGATGGAGTGTCCGTATACCAACATGTCTGATATTTTGATGTATTCCATTAAATTATTTA
GTTTTTTCTTTTTATTCTCGTTAAACAGCATTTCTGTCAACGGACCCCAACATCGTTGACCGATTAAGTTTTG

FIG. 11R

ATTGATTTTTCCGTGTAAGGCGTATCTAGTCAGATCGTATAGCCTATCCAATAATCCATCGTCTGTGCGTAGAT
CACATCGTACACTTTTTAATTCTCTATAGAAGAGCGACAGACATCTGGAGCAATTACAGACAGCAATTTCTT
TATTCTCTACAGATGTAAGATACTTGAAGACATTCCTATGATGATGCAGAATTTTGGATAACACGGTATTGAT
GGTATCTGTTACCATAATTCCTTTGATGGCTGATAGTGTCAGAGCACAAGATTTCCAATCTTTGACAATTTT
AGCACCATTATCTTTGTTTTGATATCTATATCAGACAGCATGGTGCGTCTGACAACACAAGGATTAAGACGG
AAAGATGAAATGATTCTCTCAACATCTTCAATGGATACCTTGCTATTTTTTCTGGCATTATCTATATGTGCGAG
AATATCCTCTAGAGAATCAGTATCCTTTTTGATGATAGTGGATCTCAATGACATGGGACGTCTAAACCTTCTT
ATTCTATCACCAGATTGCATGGTGATTTGTCTTCTTTCTTTTATCATAATGTAATCTCTAAATTCATCGGCAAAT
TGTCTATATCTAAAATCATAATATGAGATGTTTACCTCTACAAATATCTGTTCGTCCAATGTTAGAGTATTTACA
TCAGTTTTGTATTCCAAATTAAACATGGCAACGGATTTAATTTTATATTCCTCTATTAAGTCCTCGTCGATAATA
ACAGAATGTAGATAATCATTTAATCCATCGTACATGGTTGGAAGATGCTCGTTGACAAAATCTTTAATTGTCT
TGATGAAGGTGGGACTATATCTAACATCTTGATTAATAAAATTTATAACATTGTCCATAGGATACTTTGTAACT
AGTTTTATACACATCTCTTCATCGGTAAGTTTAGACAGAATATCGTGAACAGGTGGTATATTATATTCATCAGA
TATACGAAGAACAATGTCCAAATCTATATTGTTTAATATATTATATAGATGTAGTGTAGCTCCTACAGGAATATC
TTTAACTAAGTCAATGATTTCATCAACCGTTAGATCTATTTTAAAGTTAATCATATAGGCATTGATTTTTAAAA
GGTATGTAGCCTTGACTACATTCTCATTAATTAACCATTCCAAGTCACTGTGTGTAAGAAGATTATATTCTATC
ATAAGCTTGACTACATTTGGTCCCGATACCATTAAAGAATTCTTATGATATAAGGAAACAGATTTTAGGTACT
CATCTACTCTACAAGAATTTTGGAGAGCCTTAACGATATCAGTGACGTTTATTATTTCAGGAGGAAAAAACC
TAACATTGAGAATATCGGAATTAATAGCTTCCAGATACAGTGATTTTGGCAATAGTCCGTGTAATCCATAATC
CAGTAACACGAGCTGGTGCTTGCTAGACACCTTTTCAATGTTTAATTTTTTTGAAATAAGCTTTGATAAAGC
CTTCCTCGCAAATTCCGGATACATGAACATGTCGGCGACATGATTAAGTATTGTTTTTTCATTATTTTTATATT
TTCTCAACAAGTTCTCAATACCCCAATAGATGATAGAATATCACCCAATGCGTCCATGTTGTCTATTTCCAACA
GGTCGCTATATCCACCAATAGAAGTTTTCCCAAAAAAGATTCTAGGAACAGTTCTACCACCAGTAATTTGTT
CAAAATAGTCACGCAATTCATTTTCGGGTTTAAATTCTTTAATATCGACAATTTCATACGCTCCTCTTTTGAAA
CTAAACTTATTTAGAATATCCAGTGCATTTCTACAAAAAGGACATGTATACTTGACAAAAATTGTCACTTTGT
TATTGGCCAACCTTTGTTGTACAAATTCCTCGGCCATTTTAATATTTAAGTGATATAAAACTATCTCGACTTAT
TTAACTCTTTAGTCGAGATATATGGACGCAGATAGCTATATGATAGCCAACTACAGAAGGCAAACGCTATAA
AAAACATAATTACGACGAGCATATTTATAAATATTTTTATTCAGCATTACTTGATATAGTAATATTAGGCACAGT
CAAACATTCAACCACTCTCGATACATTAACTCTCTCATTTTCTTTAACAAATTCTGCAATATCTTCGTAAAAAG
ATTCTTGAAACTTTTTAGAATATCTATCGACTCTAGATGAAATAGCGTTCGTCAACATACTATGTTTTGTATAC
ATAAAGGCGCCCATTTTAACAGTTTCTAGTGACAAAATGCTAGCGATCCTAGGATCCTTTAGAATCACATAG
ATTGACGATTCGTCTCTCTTAGTAACTCTAGTAAAATAATCATACAATCTAGTACGCGAAATAATATTATCCTTG
ACTTGAGGAGATCTAAACAATCTAGTTTTGAGAACATCGATAAGTTCATCGGGAATGACATACATACTATCTT
TAATAGAACTCTTTTCATCCAGTTGAATGGATTCGTCCTTAACCAACTGATTAATGAGATCTTCTATTTTATCA
TTTTCCAGATGATATGTATGTCCATTAAAGTTAAATTGTGTAGCGCTTCTTTTTAGTCTAGCAGCCAATACTTT
AACATCACTAATATCGATATACAAAGGAGATGATTTATCTATGGTATTAAGAATTCGTTTTTCGACATCTGTCA
AAAACCAATTCCTTTTTGCCTGTATCATCCAGTTTTCCATCCTTTGTAAAGAAATTATTTTCTACTAGACTATTA
ATAAGACTGATAAGGATTCCTCCATAATTGCACAATCCAAACTTTTTCACAAAACTAGACTTTACAAGATCTA
CAGGAATGCGTACTTCAGGTTTCTTAGCTTGTGATTTTTTCTTTTGTGGACATTTTCTTGTGACCAACTCATC
TACCATTTCATTGATTTTAGCAGTGAAATAAGCTTTCAATGCACGGGCACTGATACTATTGAAAACGAGTTG
ATCTTCAAATTCCGCCATTTAAGTTCACCAAACAACTTTTAAATACAAATATATCAATAGTAGTAGAATAAGA
ACTATAAAAAAAATAATAATTAACCAATACCAACCCCAACAACCGGTATTATTAGTTGATGTGACTGTTTTCT
CATCACTTAGAACAGATTTAACAATTTCTATAAAGTCTGTCAAATCATCTTCCGGAGACCCCATAAATACACC
AAATATAGCGGCGTACAACTTATCCATTTATACATTGAATATTGGCTTTTCTTTATCGCTATCTTCATCATATTC

FIG. 11S

```
ATCATCAATATCAACAAGTCCCAGATTACGAGCCAGATCTTCTTCTACATTTTCAGTCATTGATACACGTTCAC
TATCTCCAGAGAGTCCGATAACGTTAGCCACCACTTCTCTATCAATGATTAGTTTCTTGAGTGCGAATGTAAT
TTTTGTTTCCGTTCCGGATCTATAGAAAACTACAGGTGTGATAATTGCCTTGGCCAATTGTCTTTCTCTTTTA
CTGAGTGATTCTAGTTCACCTTCTATAGATCTGAGAATGGATGATTCTCCAGTCGAAACATATTCTACCATGG
CTCCGTTTAATTTGTTGATGAAGATGGATTCATCCTTAAATGTTTTCTCTGTAATAGTTTCCACCGAAAGACT
ATGCAAAGAATTTGGAATGCGTTCCTTGTGCTTAATGTTTCCATAGACGGCTTCTAGAAGTTGATACAACAT
AGGACTAGCCGCGGTAACTTTTATTTTTAGAAAGTATCCATCGCTTCTATCTTGTTTAGATTTATTTTTATAAA
GTTTAGTCTCTCCTTCCAACATAATAAAAGTGGAAGTCATTTGACTAGATAAACTATCAGTAAGTTTTATAGA
GATAGACGAACAATTAGCGTATTGAGAAGCATTTAGTGTAACGTATTCGATACATTTTGCATTAGATTTACTA
ATCGATTTTGCATACTCTATAACACCCGCACAAGTCTGTAGAGAATCGCTAGATGCAGTAGGTCTTGGTGAA
GTTTCAACTCTCTTCTTGATTACCTTACTCATGATTAAACCTAAATAATTGTACTTTGTAATATAATGATATATAT
TTTCACTTTATCTCATTTGAGAATAAAAATGTTTTTGTTTAACCACTGCATGATGTACAGATTTCGGAATCAC
AAACCACCGGTGGTTTTATTTTATCCTTGTCCAATGTGAATTGAATGGGAGCGGATGCGGGTTTCGTACGTA
GATAGTACATTCCCGTTTTTAGACCGAGACTCCATCCGTAAAAATGCATACTCGTTAGTTTGGAATAACTCG
GATCTGCTATATGGATATTCATAGATTGACTTTGATCGATGAAGGCTCCCCTGTCTGCAGCCATTTTTATGATC
GTCTTTTGTGGAATTTCCCAAATAGTTTTATAAACTCGCTTAATATCTTCTGGAAGGTTTGTATTCTGAATGG
ATCCACCATCTGCCATAATCCTATTCTTGATCTCATCATTCCATAATTTTCTCTCGGTTAAAACTCTAAGGAGAT
GCGGATTAACTACTTGAAATTCTCCAGACAATACTCTCCGAGTGTAAATATTACTGGTATACGGTTCCACCGA
CTCATTATTTCCCAAAATTTGAGCAGTTGATGCAGTCGGCATAGGTGCCACCAATAAACTATTTCTAAGACC
GTATGTTCTGATTTTATCTTTTAGAGGTTCCCAATTCCAAAGATCCGACGGTACAACATTCCAAAGATCATAT
TGTAGAATACCGTTACTGGCGTACGATCCTACATATGTATCGTATGGTCCTTCCTTCTCAGCTAGTTCACAACT
CGCCTCTAATGCACCGTAATAAATGGTTTCGAAGATCTTCTTATTTAGATCTTGTGCTTCCAGGCTATCAAAT
GGATAATTTAAGAGAATAAACGCGTCCGCTAATCCTTGAACACCAATACCGATAGGTCTATGTCTCTTATTAG
AGATTTCAGCTTCTGGAATAGGATAATAATTAATATCTATAATTTTATTGAGATTTCTGACAATTACTTTGACC
ACATCCTTCAGTTTGAGAAAATCAAATCGCCCATCTATTACAAACATGTTCAAGGCAACAGATGCCAGATTA
CAAACGGCTACCTCATTAGCATCCGCATATTGTATTATCTCAGTGCAAAGATTACTACACTTGATAGTTCCTAA
ATTTTGTTGATTACTCTTTTTGTTACACGCATCCTTATAAAGAATGAATGGAGTACCAGTTTCAATCTGAGAT
TCTATAATCGCTTTCCAGACGACTCGAGCCTTTATTATAGATTTGTATCTCCTTTCTCTTTCGTATAGTGTATAC
AATCGTTCGAACTCGTCTCCCCAAACATTGTCCAATCCAGGACATTCATCCGGACACATCAACGACCACTCT
CCGTCATCCTTCACTCGTTTCATAAAGAGATCAGGAATCCAAAGAGCTATAAATAGATCTCTGGTTCTATGTT
CCTCGTTTCCTGTATTCTTTTTAAGATCGAGGAACGCCATAATATCAGAATGCCACGGTTCCAAGTATATGGC
CATAACTCCAGGCCGTTTGTTTCCTCCCTGATCTATGTATCTAGCGGTGTTATTATAAACTCTCAACATTGGAA
TAATACCGTTTGATATACCATTGGTACCGGAGATATAGCTTCCACTGGCACGAATATTACTAATTGATAGACCT
ATTCCCCCTGCCATTTTAGAGATTAATGCGCATCGTTTTAACGTGTCATAGATACCCTCTATGCTATCATCGAT
CATGTTAAGTAGAAAACAGCTAGACATTTGGTGACGACTAGTTCCCGCATTAAATAAGGTAGGAGAAGCGT
GCGTAAACCATTTTTCAGAAAGTAGATTGTACGTCTCAATAGCTGAGTCTATATCCCATTGATGAATTCCTAC
TGCGACACGCATTAACATGTGCTGAGGTCTTTCAACGATCTTGTTGTTTATTTTCAACAAGTAGGATTTTTCC
AAAGTTTTAAAACCAAAATAGTTGTATGAAAAGTCTCGTTCGTAAATAATAACCGAGTTGAGTTTATCCTTAT
ATTTGTTAACTATATCCATGGTGATACTTGAAATAATCGGAGAATGTTTCCCATTTTTAGGATTAACATAGTTG
AATAAATCCTCCATCACTTCACTAAATAGTTTTTTTGTTTCCTTGTGTAGATTTGATACGGCTATTCTGGCGGC
TAGAATGGCATAATCCGGATGTTGTGTAGTACAAGTGGCTGCTATTTCGGCTGCCAGAGTGTCCAATTCTAC
CGTTGTTACTCCATTATATATTCCTTGAATAACCTTCATAGCTATTTTAATAGGATCTATATGATCCGTGTTTAAG
CCATAACATAATTTTCTAATACGAGACGTGATTTTATCAAACATGACATTTTCCTTGTATCCATTTCGTTTAATG
ACAAACATTTTTGTTGGTGTAATAAAAAAATTATTTAACTTTTCATTAATAGGGATTTGACGTACGTAGCGTA
```

FIG. 11T

CAAAATGATTGTTCCTGGTATATAGATAAAGAGTCCTATATATTTGAAAATCGTTACGGCTCGATTAAACTTTA
ATGATTGCATAGTGAATATATCATTAGGATTTAACTCCTTGACTATCAGGGCGGCACCAGAAATTACCATCAA
AAGCATTAATACAGTTATGCCTATCGCAGTTAGAACGGTTATAGCATCCACCATTTATATCTAAAAATTAGATC
AAAGAATATGTGACAAAGTCCTAGTTGTATATTGAGAATTGACAAAACAATGTTTCTTACATATTTTTTTTTT
ATTAGTAACCGACTTAATAGTAGGAACTGGAAAACTAGACTTGATTATTCTATAAGTATAGATACCCTTCCAA
ATAATATTCTCTTTGATAAAAGTTCCAGAAAATGTAGAATTTTTTAAAAAGTTATCTTTTGCTATTACCAAGAT
TGTGTTTAGACGCTTATTATTAATATGAGTGATGAAATCCACACCGCCTCTAGATATCGCCTTTATTTCCACAT
TAGATGGTAAATCCAATAGTGAAACTATCTTTTTAGGAATGTATGGACTCGCGTTTAGAGGAGTGAACGTCT
TGGGCGTCGGAAAGGATGATTCGTCAAACGAATAAACAATTTCACAAATGGATGTTAATGTATTAGTAGGA
AATTTTTTGACGCTAGTGGAATTGAAGATTCTAATGGATGATGTTCTACCTATTTCATCCGATAACATGTTAAT
TTCCGACACCAACGGTTTTAATATTTCGATGATATACGGTAGTCTCTCTTTCGGACTTATATAGCTTATTCCAC
AATACGAGTCATTATATACTCCAAAAAACAAAATAACTAGTATAAAATCTGTATCGAATGGGAAAAACGAAA
TTATCGACATAGGTATAGAATCCGGAACATTGAACGTATTAATACTTAATTCTTTTTCTGTGGTAAGTACCGAT
AGGTTATTGACATTGTATGGTTTTAAATATTCTATAACTTGAGACTTGATAGATATTAGTGATGAATTGAAAAT
TATTTTTATCACCACGTGTGTTTCAGGATCATCGTCGACGCCCGTCAACCAACCGAATGGAGTAAAATAAAT
ATCATTAATATATGCTCTAAATATTAGTATTTTTATTAATCCTTTGATTATCATCTTCTCGTACGCGAATGATTCC
ATGATCAAGAGTGATTTGAGAACATCCTCCGGAGTATTAATGGGCTTAGTAAACAGTACATCGTTGCAATAA
TAAAAGTTATCCAAGTTAAAGGATATTATGCATTCGTTTAAAGATATCACCTCATCTGACGGAGACAATTTTT
TGGTAGGTTTTAGAGACTTTGAAGCTACTTGTTTAACAAAGTTATTCATCGTCGTTTACTATTCTATTTAATTT
TGTAGTTAATTTATCACATATCACATTAATTGACTTTTTGGTCCACTTTTCCATACGTTTATATTCTTTTAATCCT
GCGTTATCCGTTTCCGTTATATCCAGTGATAGATCGTGCAGGTTAAATAGAATGCTCTTAAATAATGTCATTTT
CTTATCCGCTAAAAATTTAAAGAATGTATAAACCTTTTTCAGAGATTTGAAACTCTTAGGTGGTGTCCTAGTA
CACAATATCATAAACAAACTAATAAACATTCCACATTCAGATTCCAACAGCTGATTAACTTCTACATTAATACA
GCCTATTTTCGCTCCAAATGTACATTCGAAAAATCTGAATAAAACATCGATGTCACAATTTGTATTATCCAATA
CAGAATGTCTGTGATTCGTGTTAAAACCATCGGAGAAGGAATAGAAATAAAAATTATTATAGTGGTGGAATT
CAGTTGGAATATTGCCTCCGGAGTCATAAAAGGATACTAAACATTGTTTTTTATCATAAATTACACATTTCCA
ATGAGACAAATAACAAAATCCAAACATTACAAATCTAGAGGTAGAACTTTTAATTTTGTCTTTAAGTATATAC
GATAAGATATGTTTATTCATAAACGCGTCAAATTTTTCATGAATCGCTAAGGAGTTTAAGAATCTCATGTCAA
ATTGTCCTATATAATCCACTTCGGATCCATAAGCAAACTGAGAGACTAAGTTCTTAATACTTCGATTGCTCATC
CAGGCTCCTCTCTCAGGCTCTATTTTCATCTTGACGACCTTTGGATTTTCACCAGTATGTATTCCTTTACGTG
ATAAATCATCGATTTTCAAATCCATTTGTGAGAAGTCTATCGCCTTAGATACTTTTTCCCGTAGTCGAGGTTT
AAAGAAATACGCTAACGGTATACTAGTAGGTAACTCAAAGACATCATATATAGAATGGTAACGCGTCTTTAA
CTCGTCGGTTAACTCTTTCTTTTGATCGAGTTCGTCGCTACTATTGGGTCTGCTCAGGTGCCCCAACTCTACT
AGTTCCAACATCATACCGATAGGAATACAAGACACTTTGCCAGCGGTTGTAGATTTATCATATTTCTCCACTA
CATATCCGTTACAATTTGTTAAAAAATTTAGATACATCTATATTGCTACATAATCCAGCTAGTGAATATATATGAC
ATAATAAATTGGTAAATCCTAGTTCTGGTATTTTACTAATTACTAAATCTGTATATCTTTCCATTTATCATGGAA
AAGAATTTACCAGATATCTTCTTTTTTCCAAACTGCGTTAATGTATTCTCTTACAAATATTCACAAGATGAATT
CAGTAATATGAGTAAAACGGAACGTGATAGTTTCTCATTGGCCGTGTTTCCAGTTATAAAACATAGATGGCA
TAACGCACACGTTGTAAAACATAAAGGAATATACAAAGTTAGTACAGAAGCACGTGGAAAAAAAGTATCTC
CTCCATCACTAGGAAAACCCGCACACATAAACCTAACCGCGAAGCAATATATATACAGTGAACACACAATAA
GCTTTGAATGTTATAGTTTTCTAAAATGTATAACAAATACAGAAATCAATTCGTTCGATGAGTATATATTAAGA
GGACTATTAGAAGCTGGTAATAGTTTACAGATATTTTCCAATTCCGTAGGTAAACGAACAGATACTATAGGT
GTACTAGGGAATAAGTATCCATTTAGCAAAATTCCATTGGCCTCATTAACTCCTAAAGCACAACGAGAGATA
TTTTCAGCGTGGATTTCTCATAGACCTGTAGTTTTAACTGGAGGAACTGGAGTGGGTAAGACGTCACAGGT

FIG. 11U

```
ACCCAAGTTATTGCTTTGGTTTAATTATTTATTTGGTGGATTCTCTACTCTAGATAAAATCACTAACTTTCACG
AAAGACCAGTCATTCTATCTCTTCCTAGGATAGCTTTAGTTAGATTGCATAGCAATACCATTTTAAAATCATTG
GGATTTAAGGTACTAGATGGATCTCCTATTTCTTTACGGTACGGATCTATACCGGAAGAATTAATAAACAAAC
AACCAAAAAAATATGGAATTGTATTTTCTACCCATAAGTTATCTCTAACAAAACTATTTAGTTATGGCACTCTT
ATTATAGACGAAGTTCATGAGCATGATCAAATAGGAGATATTATTATAGCAGTAGCGAGAAAGCATCATACG
AAAATAGATTCTATGTTTTTAATGACTGCCACGTTAGAGGATGACCGAGAACGGCTAAAAGTATTTTTACCT
AATCCCGCATTTATACATATTCCTGGAGATACACTGTTTAAAATTAGCGAGGTATTTATTCATAATAAGATAAA
TCCATCTTCCAGAATGGCATACATAGAAGAAGAAAAGAGAAATTTAGTTACTGCTATACAGATGTATACTCC
TCCTGATGGATCATCCGGTATAGTCTTTGTGGCATCCGTTGCACAGTGTCACGAATATAAATCATATTTAGAA
AAAAGATTACCGTATGATATGTATATTATTCATGGTAAGGTCTTAGATATAGACGAAATATTAGAAAAAGTGTA
TTCATCACCTAATGTATCGATAATTATTTCTACTCCTTATTTGGAATCCAGCGTTACTATACGCAATGTTACACA
CATTTATGATATGGGTAAAGTTTTTGTCCCCGCTCCTTTTGGAGGATCGCAAGAATTTATTTCTAAATCTATG
AGAGATCAACGAAAAGGAAGAGTAGGAAGAGTTAATCCTGGTACATACGTCTATTTCTATGATCTGTCTTAT
ATGAAGTCTATACAGCGAATAGATTCAGAATTTCTACATAATTATATATTGTACGCTAATAAGTTTAATCTAACA
CTCCCCGAAGATTTGTTTATAATCCCTACAAATTTGGATATTCTATGGCGTACAAAGGAATATATAGACTCGTT
CGATATTAGTACAGAAACATGGAATAAATTATTATCCAATTATTATATGAAGATGATAGAGTATGCTAAACTTT
ATGTACTAAGTCCTATTCTCGCTGAGGAGTTGGATAACTTTGAGAGGACGGGAGAATTAACTAGTATTGTAC
GAGAAGCCATTTTATCTCTAAATTTACGAATTAAGATTTTAAATTTTAAACATAAAGATGATGATACGTATATA
CACTTTTGTAAAATATTATTCGGTGTCTATAACGGAACAAACGCTACTATATATTATCATAGACCTCTAACGGG
ATATATGAATATGATTTCAGATACTATATTTGTTCCTGTAGATAATAACTAAAAATCAAACTCTAATGACCACAT
CTTTTTTTAGAGATGAAAAATTTTCCACATCTCCTTTTGTAGACACGACTAAACATTTTGCAGAAAAAAGTT
TATTAGTGTTTAGATAATCGTATACTTCATCAGTGTAGATAGTAAATGTGAACAGATAAAAGGTATTCTTGCTC
AATAGATTGGTAAATTCCATAGAATATATTAATCCTTTCTTCTTGAGATCCCACATCATTTCAACCAGAGACGT
TTTATCCAATGATTTACCTCGTACTATACCACATACAAAACTAGATTTTGCAGTGACGTCGTACCTGGTATTCC
TACCAAACAAAATTTTACTTTTAGTTCTTTTAGAAAATTCTAAGGTAGAATCTCTATTTGCCAATATGTCATCT
ATGGAATTACCACTAGCAAAAAATGATAGAAATATATATTGATACATCGCAGCTGGTTTTGATCTACTATACTT
TAAAAACGAATCAGATTCCATAATTGCCTGTATATCATCAGCTGAAAAACTATGTTTTACACGTATTCCTTCG
GCATTTCTTTTTAATGATATATCTTGTTTAGACAATGATAAAGTTATCATGTCCATGAGAGACGCGTCTCCGTA
TCGTATAAATATTTCATTAGATGTTAGACGCTTCATTAGGGGTATACTTCTATAAGGTTTCTTAATTAGTCCATC
ATTTGTTGCGTCAAGAACTACTATCGGATGTTGTTGGGTATCTCTAGTGTTACACATGGCCTTACTAAAGTTT
GGGTAAATAACTATGATATCTCTATTAATTATAGATGCATATATTTCATTTGTCAAGGATATTAGTATCGACTTG
CTATCGTCATTAATACGTGTAATGTAATCATATAAATCATGCGATAGCCAAGGAAAATTCAAATAGATGTTCAT
CATATAATCGTCGCTATAATTCATATTAATACTTTGACATTGACTAATTTGTAATATAGCCTCGCCACGAAGAA
AGCTCTCGTATTCAGTTTCATCGATAAAGGATACCGTTAAATATAACTGGTTGCCGATAGTCTCATAGTCTATT
AAGTGGTAAGTTTCGTACAAATACAGAATCCCTAAAATATTATCTAATGTTGGATTAATCTTTACCATAACTGT
ATAAAATGGAGACGGAGTCATAACTATTTTACCGTTTGTACTTACTGGAATAGACGAAGGAATAATCTCCGG
ACATGCTGGTAAAGACCCAAATGTCTGTTTGAAGAAATCCAATGTTCCAGGTCCTAATCTCTTAACAAAAT
TACGATATTCGATCCCGATATCCTTTGCATTCTATTTACCAGCATATCACGAACTATATTAAGATTATCTATCATG
TCTATTCTCCCACCGTTATATAAATCGCCTCCGCTAAGAAACGTTAGTATATCCATACAATGGAATACTTCATTT
CTAAAATAGTATTCGTTTTCTAATTCTTTAATGTGAAATCGTATACTAGAAAGGGAAAAATTATCTTTGAGTTT
TCCGTTAGAAAAGAACCACGAAACTAATGTTCTGATTGCGTCCGATTCCGTTGCTGAATTAATGGATTTACA
CCAAAAACTCATATAACTTCTAGATGTAGAAGCATTCGCTAAAAAATTAGTAGAATCAAAGGATATAAGTAG
ATGTTCCAACAAGTGAGCAATTCCCAAGATTTCATCTATATCATTCTCGAATCCGAAATTAGAAATTCCCAAG
TAGATATCCTTTTTCATCCGATCGTTGATGAAAATACGAACTTTATTCGGTAAGACAATCATTTACTAAGGAG
```

FIG. 11V

TAAAATAGGAAGTAATGTTCGTATGTCGTTATCATCGTATAAATTAAAGGTGTGTTTTTTACCATTAAGTGAC
ATTATAATTTTACCAATATTGGAATTATAATATAGGTGTATTTGCGCACTCGCGACGGTTGATGCATCGGTAAA
TATAGCTGTATCTAATGTTCTAGTCGGTATTTCATCATTTCGCTGTCTAATAATAGCGTTTTCTCTATCTGTTTCC
ATTACAGCTGCCTGAAGTTTATTGGTCGGATAATATGTAAAATAATAAGAAATACATACGAATAACAAAAATA
AAATAAGATATAATAAAGATGCCATTTAGAGATCTAATTTTGTTTAACTTGTCCAAATTCCTACTTACAGAAG
ATGAGGAATCGTTGGAGATAGTGTCTTCCTTATGTAGAGGATTTGAAATATCTTATGATGACTTGATAACTTA
CTTTCCAGATAGGAAATACCATAAATATATTTCTAAAGTATTTGAACATGTAGATTTATCGGAGGAATTAAGT
ATGGAATTCCATGATACAACTCTGAGAGATTTAGTCTATTCTTAGATTGTACAAGTATTCCAAGTGTATACGG
CCGTGTTATAAATTAGGAGATAATCTAAAAGGCATAGTTGTTATAAAGGACAGGAATATTTATATTAGAGAA
GCAAATGATGACTTGATAGAATATCTCCTCAAGGAATACACTCCTCAGATTTATACATATTCTAATGAGCGCG
TCCCCATAACTGGTTCAAAATTAATTCTTTGTGGATTTTCTCAAGTTACATTTATGGCGTATACAACGTCGCAT
ATAACAACAAATAAAAAGGTAGATGTTCTCGTTTCCAAAAAATGTATAGATGAACTAGTCGATCCAATAAAT
TATCAAATACTTCAAAATTTATTTGATAAAGGAAGCGGAACAATAAACAAAATACTCAGGAAGATATTTTATT
CGGTAACCGGTGGCCAAACTCCATAATTTGCTTTTTCTATTTCGGATTTTAGAATTTCCAAATTCACCAGCGA
TTTATCGGTTTTGGTGAAATCCAAGGATTTATTAATGTCCACAAATGCCATTTGTTTTGTCTGTGGATTGTATT
TGAAAATGGAAACGATGTAGTTAGATAGATGCGCTGCAAAGTTTCCTATTAGGGTTCCGCGCTTTACGTCA
CCCAGCATACTTGAATCACCATCCTTTAAAAAAAATGATAAGATATCAACATGGAGTATATCATACTCGGATT
TTAATTCTTCTACTGCATCACTGACATTTTCACAAATACTACAATACGGTTTACCGAAAATAATCAGTACGTTC
TTCATTTATGGGTATCAAAAACTTAAAATCGTTACTGCTGGAAAATAAATCACTGACGATATTAGATGATAAT
TTATACAAAGTATACAATGGAATATTTGTGGATACAATGAGTATTTATATAGCCGTCGCCAATTGTGTCAGAA
ACTTAGAAGAGTTAACTACGGTATTCATAAAATACGTAAACGGATGGGTAAAAAAGGGAGGGCATGTAACC
CTTTTTATCGATAGAGGAAGTATAAAAATTAAACAAGACGTTAGAGACAAGAGACGTAAATATTCTAAATTA
ACCAAGGACAGAAAAATGCTAGAATTAGAAAAGTGTACATCCGAAATACAAAATGTTACCGGATTTATGGA
AGAAGAAATAAAGGCAGAAATGCAATTAAAAATCGATAAACTCACATTTCAAATATATTTATCTGATTCTGAT
AACATAAAAATATCATTGAATGAGATACTAACACATTTCAACAATAATGAGAATGTTACATTATTTTATTGTGA
TGAACGAGACGCAGAATTCGTTATGTGTCTCGAGGCTAAAACACATTTCTCTACCACAGGAGAATGGCCGT
TGATAATAAGTACCGATCAGGATACTATGCTATTTGCATCTACTGATAATCATCCTAAGATGATAAAAAACTTA
ACTCAACTGTTTAAATTTGTTCCCTCGGCAGAGGATAACTATTTAGCAAAATTAACGGCGTTAGTGAATGGA
TGTGATTTCTTTCCTGGACTCTATGGGGCATCTATAACACCCACCAACTTAAACAAAATACAATTGTTTAGTG
ATTTTACAATCGATAATATAGTCACTAGTTTGGCAATTAAAAATTATTATAGAAAGACTAACTCTACCGTAGAC
GTGCGTAATATTGTTACGTTTATAAACGATTACGCTAATTTAGACGATGTCTACTCGTATGTTCCTCCTTGTCA
ATGCACTGTTCAAGAATTTATATTTTCCGCATTAGATGAAAAATGGAACAATTTTAAATCATCTTATTTAGAG
ACCGTTCCGTTACCCTGCCAATTAATGTATGCATTAGAACCACGCAAGGAGATTGATGTTTCAGAAGTTAAA
ACTTTATCATCTTATATAGATTTCGAAAATACTAAATCAGATATCGATGTTATAAAATCTATATCTTCGATCTTCG
GATATTCTAACGAAACTGTAACACTATAGTGTTCGGCATCTATAAGGATAATTTACTACTGAGTATAAATAGT
TCATTTTACTTTAACGATAGTCTGTTAATAACCAATACTAAAAGTGATAATATAATAAATATAGGTTACTAGATT
AAAAATGGTGTTCCAACTCGTGTGCTCTACATGCGGCAAAGATATTTCTCACGAACGATATAAATTGATTATA
CGAAAAAAATCATTAAAGGATGTACTCGTCAGTGTAAAGAACGAATGTTGTAGGTTAAAATTATCTACACAA
ATAGAACCTCAACGTAACTTAACAGTGCAACCTCTATTGGATATAAACTAATATGGATCCGGTTAATTTTATCA
AGACATATGCGCCTAGAGGTTCTATTATTTTTATTAATTATACCATGTCATTAACAAGTCATTTGAATCCATCG
ATAGAAAAACATGTGGGTATTTATTATGGTACGTTATTATCGGAACACTTGGTAGTTGAATCTACCTATAGAA
AAGGAGTTCGAATAGTCCCATTGGATAGTTTTTTTGAAGGATATCTTAGTGCAAAAGTATACATGTTAGAGA
ATATTCAAGTTATGAAAATAGCAGCTGATACGTCATTAACTTTATTGGGTATTCCGTATGGATTTGGTCATGAT
AGAATGTATTGTTTTAAATTGGTAGCTGAATGTTATAAAAATGCCGGTATTGATACATCGTCTAAACGAATATT

FIG. 11W

AGGTAAAGATATTTTTCTGAGCCAAAACTTCACAGATGATAATAGATGGATAAAGATATATGATTCTAATAAT
TTAACATTTTGGCAAATTGATTACCTTAAAGGGTGAGTTAATATGCATAACTACTCCTCCGTTGTTTTTTCCCT
CGTTCTTTTTCTTAACGTTGTTTGCCATCACTCTCATAATGTAAAGATATTCTAAAATGGTAAACTTTTGCATA
TCGGACGCAGAAATTGGTATAAATGTTGTAATTGTATTATTTCCCGTCAATGGACTAGTCACAGCTCCATCAG
TTTTATATCCTTTAGAGTATTTCTCACTCGTGTCTAACATTCTAGAGCATTCCATGATCTGTTTATCGTTGATAT
TGGCCGGAAAGATAGATTTTTTATTTTTTATTATATTACTATTGGCAATTGTAGATATAACTTCTGGTAAATATT
TTTCTACCTTTTCAATCTCTTCTATTTTCAAGCCGGCTATATATTCTGCTATATTGTTGCTAGTATCAATACCTTT
TCTGGCTAAGAAGTCATATGTGGTATTCACTATATCAGTTTTAACTGGTAGTTCCATTAGCCTTTCCACTTCTG
CAGAATAATCAGAAATTGGTTCTTTACCAGAAAATCCAGCTACTATAATAGGCTCACCGATGATCATTGGCA
AAATCCTATATTGTACCAGATTAATGAGAGCATATTTCATTTCCAATAATTCTGCTAGTTCTTGAGACATTGAT
TTATTTGATGAATCTAGTTGGTTCTCTAGATACTCTACCATTTCTGCCGCATACAATAACTTGTTAGATAAAAT
CAGGGTTATCAAAGTGTTTAGCGTGGCTAGAATAGTGGGCTTGCATGTATTAAAGAATGCGGTAGTATGAG
TAAACCGTTTTAACGAATTATATAGTCTCCAGAAATCTGTGGCGTTACATACATGAGCCGAATGACATCGAA
GATTGTCCAATATTTTTAATAGCTGCTCTTTGTCCATTATTTCTATATTTGACTCGCAACAATTGTAGATACCAT
TAATCACCGATTCCTTTTTCGATGCCGGACAATAGCACAATTGTTTAGCTTTGGACTCTATGTATTCAGAATT
AATAGATATATCTCTTAATACAGATTGCACTATACATTTTGAAACTATGTCAAAAATTGTAGAACGACGCTGTT
CTGCAGCCATTTAACTTTAAATAATTTACAAAAATTTAAAATGAGCATCCGTATAAAAATCGATAAACTGCGC
CAAATTGTGGCATATTTTTCAGAGTTCAGTGAAGAAGTATCTATAAATGTAGACTCGACGGATGAGTTAATG
TATATTTTTGCCGCCTTGGGCGGATCTGTAAACATTTGGGCCATTATACCTCTCAGTGCATCAGTGTTCTACC
GCGGAGCCGAAAACATTGTGTTTAATCTTCCTGTGTCCAAGGTAAAATCGTGTTTGTGTAGTTTTCACAATG
ATGCCATCATAGATATAGAACCTGATCTGGAAAATAATCTAGTAAAACTTTCTAGTTATCATGTAGTAAGTGTC
GATTGTAACAAGGAACTGATGCCTATTAGGACAGATACTACTATTTGTCTAAGTATAGATCAAAAGAAATCTT
ACGTGTTTAATTTTCACAAGTATGAAGAAAAATGTTGTGGTAGAACCGTCATTCATTTAGAATGGTTGTTGG
GCTTTATCAAGTGTATTAGTCAGCATCAGCATTTGGCTATTATGTTTAAAGATGACAATATTATTATGAAGACT
CCTGGTAATACTGATGCGTTTTCCAGGGAATATTCTATGACTGAATGTTCTCAAGAACTACAAAAGTTTTCTT
TCAAAATAGCTATCTCGTCTCTCAACAAACTACGAGGATTCAAAAAGAGAGTCAATGTTTTTGAAACTAGA
ATCGTAATGGATAATGACGATAACATTCTAGGAATGTTGTTTTCGGATAGAGTTCAATCCTTTAAGATCAACA
TCTTTATGACGTTTTTAGATTAATACTTTCAATGAGATAAATATGGGTGGCGGAGTAAGTGTTGAGCTCCCTA
AACGGGATCCGCCTCCGGGAGTACCCACTGATGAGATGTTATTAAACGTGGATAAAATGCATGACGTGATA
GCTCCCGCTAAGCTTTTAGAATATGTGCATATAGGACCACTAGCAAAAGATAAAGAGGATAAAGTAAAGAA
AAGATATCCAGAGTTTAGATTAGTCAACACAGGACCCGGTGGTCTTTCGGCATTGTTAAGACAATCGTATAA
TGGAACCGCACCCAATTGCTGTCGCACTTTTAATCGTACTCATTATTGGAAGAAGGATGGAAAGATATCAG
ATAAGTATGAAGAGGGTGCAGTATTAGAATCGTGTTGGCCAGACGTTCACGACACCGGAAAATGCGATGT
TGATTTATTCGACTGGTGTCAGGGGGATACGTTCGATAGAAACATATGCCATCAGTGGATCGGTTCAGCCTT
TAATAGGAGTAATAGAACTGTAGAGGGTCAACAATCGTTAATAAATCTGTATAATAAGATGCAAACATTATGT
AGTAAAGATGCTAGTGTACCAATATGTGAATCATTTTTGCATCATTTACGCGCACACAATACAGAAGATAGC
AAAGAGATGATCGATTATATTCTAAGACAACAGTCTGCGGACTTTAAACAGAAATATATGAGATGTAGTTAT
CCCACTAGAGATAAGTTAGAAGAGTCATTAAAATATGCGGAACCTCGAGAATGTTGGGATCCAGAGTGTTC
GAATGCCAATGTTAATTTCTTGCTAACACGTAATTATAATAATTTAGGACTTTGCAATATTGTACGATGTAATA
CTAGCGTGAACAACTTACAGATGGATAAAACTTCCTCATTAAGATTGTCATGTGGATTAAGCAATAGTGATA
GATTTTCTACTGTTCCCGTCAATAGAGCAAAAGTAGTTCAACATAATATTAAACACTCGTTCGACCTAAAATT
GCATTTGATCAGTTTATTATCTCTCTTGGTAATATGGATACTAATTGTAGCTATTTAAATGGGTGCCGCGGCAA
GCATACAGACGACGGTGAATACACTCAGCGAACGTATCTCGTCTAAATTAGAACAAGAAGCGAATGCTAGT
GCTCAAACAAAATGTGATATAGAAATCGGAAATTTTTATATCCGACAAAACCATGGATGTAACCTCACTGTT

FIG. 11X

AAAAAATATGTGCTCTGCGGACGCGGATGCTCAGTTGGATGCTGTGTTATCAGCCGCTACAGAAACATATAGT
GGATTAACACCGGAACAAAAAGCATACGTGCCAGCTATGTTTACTGCTGCGTTAAACATTCAGACGAGTGT
AAACACTGTTGTTAGAGATTTTGAAAATTATGTGAAACAGACTTGTAATTCTAGCGCGGTCGTCGATAACAA
ATTAAAGATACAAAACGTAATCATAGATGAATGTTACGGAGCCCCAGGATCTCCAACAAATTTGGAATTTAT
TAATACAGGATCTAGCAAAGGAAATTGTGCCATTAAGGCGTTGATGCAATTGACGACTAAGGCCACTACTC
AAATAGCACCTAAACAAGTTGCTGGTACAGGAGTTCAGTTTTATATGATTGTTATCGGTGTTATAATATTGGC
AGCGTTGTTTATGTACTATGCCAAGCGTATGTTGTTCACATCCACCAATGATAAAATCAAACTTATTTTAGCC
AATAAGGAAAACGTCCATTGGACTACTTACATGGACACATTCTTTAGAACTTCTCCGATGGTTATTGCTACC
ACGGATATGCAAAACTGAAAATATATTGATAATATTTTAATAGATTAACATGGAAGTTATCACTGATCGTCTAG
ACGATATAGTGAAACAAAATATAGCGGATGAAAAATTTGTAGATTTTGTTATACACGGTCTAGAGCATCAAT
GTCCTGCTATACTTCGACCATTAATTAGGTTGTTTATTGATATACTATTATTTGTTATAGTAATTTATATTTTTAC
GGTACGTCTAGTAAGTAGAAATTATCAAATGTTGTTGGCGTTGGTGGCGCTAGTCATCACATTAACTATTTTT
TATTACTTTATACTATAATAGTACTAGACTGACTTCTAACAAACATCTCACCTGCCATAAATAAATGCTTGATAT
TAAAGTCTTCTATTTCTAACACTATTCCATCTGTGGAAAATAATACTCTGACATTATCGCTAATTGACACATCG
GTGAGTGATATGCCTATAAAGTAATAATCTTCTTTGGGCACATATACCAGTGTACCAGGTTCTAACAACCTAT
TTACTGGTGCTCCTATAGCATACTTTTTCTTTACCTTGAGAATATCCATCGTTTGCTTGGTCAATAGCGATATG
TGATTTTTTATCAACCACTCGAAAAAGTAATTGGAGTGTTCATATCCTCTACGGGCTATTGTCTCATGGCCGT
GTATGAAATTTAAGTAACACGACTGTGGTAGATTTGTTCTATAGAGCCGGTTGCCGCAAATAGATAGAACTA
CCAATATGTCTGTACAAATGTTAAACATTAATTGATTAACAGAAAAAACAATGTTCGTTCTGGGAATAGAAA
CCAGATCAAAACAAAATTCGTTAGAATATATGCCACGTTTATACATTGAATATAAAATAACTACAGTTTGAAA
AATAACAGTATCATTTAAACATTTAACTTGCGGGGTTAATCTCACAACTTTACTGTTTTTGAACTGTTCAAAA
TATAGCATAGATCCGTGAGAAATACGTTTAGCCGCCTTTAATAGAGGAAATCCCACCGCCTTTCTGGATCTC
ACCAACGACGATAGTTCTGACCAGCAACTCATTTCTTCATCATCCACCTGTTTTAACATATAATAGGCAGGA
GATAGATATCCGTCATTGCAATATTCCTTCTCGTAGGCACACAATCTAATATTGATAAAATCTCCATTCTCTTCT
CTGCATTTATTATCTTGTTTCGGTGGCTGATTAGGCTGTAGTCTTGGTTTAGGCTTTGGTATATCGTTGTTGA
ATCTATTTTGGTCATTAAATCTTTCATTTCTTCCTGGTATATTTTTATCACCTCGTTTGGTTGGATTTTTGTCTAT
ATTATCGTTTGTAACATCGGTACGGGTATTCATTTATCACAAAAAAAACTTCTCTAAATGAGTCTACTGCTAG
AAAACCTCATCGAAGAAGATACCATATTTTTTGCAGGAAGTATATCTGAGTATGATGATTTACAAATGGTTAT
TGCCGGCGCAAAATCCAAATTTCCAAGATCTATGCTTTCTATTTTTAATATAGTACCTAGAACGATGTCAAAA
TATGAGTTGGAGTTGATTCATAACGAAAATATCACAGGAGCAATGTTTACCACAATGTATAATATAAGAAAC
AATTTGGGTCTAGGAGATGATAAACTAACTATTGAAGCCATTGAAAACTATTTCTTGGATCCTAACAATGAA
GTTATGCCTCTTATTATTAATAATACGGATATGACTGCCGTCATTCCTAAAAAAAGTGGTAGGAGAAAGAATA
AGAACATGGTTATCTTCCGTCAAGGATCATCACCTATCTTGTGTATTTTCGAAACTCGTAAAAAGATTAATAT
TTATAAAGAAAATATGGAATCCGCGTCGACTGAGTATACACCTATCGGAGACAACAAGGCTTTGATATCTAA
ATATGCGGGAATTAATGTCCTGAATGTGTATTCTCCTTCCACATCCATGAGATTGAATGCCATTTACGGATTC
ACCAATAAAAATAAACTAGAGAAACTTAGTACTAATAAGGAACTAGAATCGTATAGTTCTAGCCCTCTTCAA
GAACCCATTAGGTTAAATGATTTTCTGGGACTATTGGAATGTGTTAAAAAGAATATTCCTCTAACAGATATTC
CGACAAAGGATTGATTACTATAAATGGAGAATGTTCCTAATGTATACTTTAATCCTGTGTTTATAGAGCCCAC
GTTTAAACATTCTTTATTAAGTGTTTATAAACACAGATTAATAGTTTTATTTGAAGTATTCGTTGTATTCATTCT
AATATATGTATTTTTTAGATCTGAATTAAATATGTTCTTTATGCCTAAACGAAAATACCCGATCCTATTGATAG
ATTACGACGTGCTAATCTAGCGTGTGAAGACGATAAATTAATGATCTATGGATTACCATGGATGACAACTCA
AACATCTGCGTTATCAATAAATAGTAAACCGATAGTGTATAAAGATTGTGCAAAGCTTTTGCGATCAATAAAT
GGATCACAACCAGTATCTCTTAACGATGTTCTTCGCAGATGATGATTCATTTTTTAAGTATTTGGCTAGTCAA
GATGATGAATCTTCATTATCTGATATATTGCAAATCACTCAATATCTAGACTTTCTGTTATTATTATTGATCCAAT

FIG. 11Y

CAAAAAATAAATTAGAAGCCGTGGGTCATTGTTATGAATCTCTTTCAGAGGAATACAGACAATTGACAAAA
TTCACAGACTTTCAAGATTTTAAAAAACTGTTTAACAAGGTCCCTATTGTTACAGATGGAAGGGTCAAACTT
AATAAAGGATATTTGTTCGACTTTGTGATTAGTTTGATGCGATTCAAAAAAGAATCCTCTCTAGCTACCACC
GCAATAGATCCTATTAGATACATAGATCCTCGTCGTGATATCGCATTTTCTAACGTGATGGATATATTAAAGTC
GAATAAAGTGAACAATAATTAATTCTTTATTGTCATCATGAACGGCGGACATATTCAGTTGATAATCGGCCCC
ATGTTTTCAGGTAAAAGTACAGAATTAATTAGACGAGTTAAACGAGCTCAAAAATTGAAAAACTAGCGTC
　　　　　　　　　　　　　　　　　　　　　　　　　　　　　　Promoter
TTTTTTGCTCGAAGTCGACCACCATGCCACCTCCTCGCCTCCTCTTCTTCCTCCTCTTCCTCACCCCCATGG
　　　　　　　　　　　　　　　　CD19t
AAGTCAGGCCCGAGGAACCTCTAGTGGTGAAGGTGGAAGAGGGAGATAACGCTGTGCTGCAGTGCCTC
AAGGGGACCTCAGATGGCCCCACTCAGCAGCTGACCTGGTCTCGGGAGTCCCCGCTTAAACCCTTCTTAA
AACTCAGCCTGGGGCTGCCAGGCCTGGGAATCCACATGAGGCCCCTGGCCATCTGGCTTTTCATCTTCAA
CGTCTCTCAACAGATGGGGGGGCTTCTACCTGTGCCAGCCGGGGCCCCCCTCTGAGAAGGCCTGGCAGCC
TGGCTGGACAGTCAATGTGGAGGGCAGCGGGGAGCTGTTCCGGTGGAATGTTTCGGACCTAGGTGGCC
TGGGCTGTGGCCTGAAGAACAGGTCCTCAGAGGGCCCCAGCTCCCCTTCCGGGAAGCTCATGAGCCCCA
AGCTGTATGTGTGGGCCAAAGACCGCCCTGAGATCTGGGAGGGAGAGCCTCCGTGTGTCCCACCGAGG
GACAGCCTGAACCAGAGCCTCAGCCAGGACCTCACCATGGCCCCTGGCTCCACACTCTGGCTGTCCTGTG
GGGTACCCCCTGACTCTGTGTCCAGGGGCCCCCTCTCCTGGACCCATGTGCACCCAAGGGGCCTAAGTC
ATTGCTGAGCCTAGAGCTGAAGGACGATCGCCCTGCCAGAGATATGTGGGTAATGGAGACGGGTCTGTT
GTTGCCCCGGGCCACAGCTCAAGACGCTGGAAAGTATTATTGTCACCGTGGCAACCTGACCATGTCATTC
CACCTGGAGATCACTGCTCGGCCAGTACTATGGCACTGGCTGCTGAGGACTGGTGGCTGGAAGGTCTCA
GCTGTGACTTTGGCTTATCTGATCTTCTGCCTGTGTTCCCTTGTGGGCATTCTTCATCTTCAAAGAGCCCTG
GTCCTGAGGAGGAAAAGATGATTAATTAATTTTTATGGATCCGCTAGCGGCCGCGGAGGTAATGATATGTA
TCAATCGGTGTGTAGAAAGTGTTACATCGACTCATAATATTATATTTTTTATCTAAAAAACTAAAAATAAACAT
TGATTAAATTTTAATATAATACTTAAAAATGGATGTTGTGTCGTTAGATAAACCGTTTATGTATTTTGAGGAAA
TTGATAATGAGTTAGATTACGAACCAGAAAGTGCAAATGAGGTCGCAAAAAAACTGCCGTATCAAGGACA
GTTAAAACTATTACTAGGAGAATTATTTTTTCTTAGTAAGTTACAGCGACACGGTATATTAGATGGTGCCACC
GTAGTGTATATAGGATCTGCTCCCGGTACACATATACGTTATTTGAGAGATCATTTCTATAATTTAGGAGTGAT
CATCAAATGGATGCTAATTGACGGCCGCCATCATGATCCTATTTTAAATGGATTGCGTGATGTGACTCTAGTG
ACTCGGTTCGTTGATGAGGAATATCTACGATCCATCAAAAAACAACTGCATCCTTCTAAGATTATTTTAATTT
CTGATGTGAGATCCAAACGAGGAGGAAATGAACCTAGTACGGCGGATTTACTAAGTAATTACGCTCTACAA
AATGTCATGATTAGTATTTTAAACCCCGTGGCGTCTAGTCTTAAATGGAGATGCCCGTTTCCAGATCAATGG
ATCAAGGACTTTTATATCCCACACGGTAATAAAATGTTACAACCTTTTGCTCCTTCATATTCAGCTGAAATGA
GATTATTAAGTATTTATACCGGTGAGAACATGAGACTGACTCGAGTTACCAAATTAGACGCTGTAAATTATG
AAAAAAAGATGTACTACCTTAATAAGATCGTCCGTAACAAAGTAGTTGTTAACTTTGATTATCCTAATCAGGA
ATATGACTATTTTCACATGTACTTTATGCTGAGGACCGTGTACTGCAATAAAACATTTCCTACTACTAAAGCA
AAGGTACTATTTCTACAACAATCTATATTTCGTTTCTTAAATATTCCAACAACATCAACTGAAAAAGTTAGTCA
TGAACCAATACAACGTAAAATATCTAGCAAAAATTCTATGTCTAAAAACAGAAATAGCAAGAGATCCGTACG
CGGTAATAAATAGAAACGTGCTACTGAGATATACTACCGATATAGAGTATAATGATTTAGTTACTTTAATAACC
GTTAGACATAAAATTGATTCTATGAAAACTGTGTTTCAGGTATTTAACGAATCATCCATAAATTATACTCCGGT
TGATGATGATTATGGAGAACCAATCATTATAACATCGTATCTTCAAAAAGGTCATAACAAGTTTCCTGTAAAT
TTTCTATACATAGATGTGGTAATATCTGACTTATTTCCTAGCTTTGTTAGACTAGATACTACAGAAACTAATATA
GTTAATAGTGTACTACAAACAGGTGATGGTAAAAAGACTCTTCGTCTTCCCAAAATGTTAGAGACGGAAAT
AGTTGTCAAGATTCTCTATCGCCCTAATATACCATTAAAAAATTGTTAGATTTTTCCGCAATAACATGGTAACTG

FIG. 11Z

```
GAGTAGAGATAGCCGATAGATCTGTTATTTCAGTCGCTGATTAATCAATTAGTAGAGATGAGATAAGAACAT
TATAATAATCAATAATATATCTTATATCTTATATCTTATATCTTATATCTTGTTTAGAAAAATGCTAATATTAAAATA
GCTAACGCTAGTAATCCAATCGGAAGCCATTTGATATCTATAATAGGGTATCTAATTTCCTGATTTAAATAGCG
GACAGCTATATTCTCGGTAGCTACTCGTTTGGAATCACAAACATTATTTACATCTAATTTACTATCTGTAATGG
AAACGTTTCCCAATGAAATGGTACAATCCGATACATTGCATTTTGTTATATTTTTTTTTAAAGAGGCTGGTAA
CAACGCATCGCTTCGTTTACATGGCTCGTACCAACAATAATAGGGTAATCTTGTATCTATTCCTATCCGTACTA
TGCTTTTATCAGGATAAATACATTTACATCGTATATCGTCTTTGTTAGCATCACAGAATGCATAAATTTGTTCG
TCCGTCATGATAAAAATTTAAAGTGTAAATATAACTATTATTTTTATAGTTGTAATAAAAAGGGAAATTTGATT
GTATACTTTCGGTTCTTTAAAAGAAACTGACTTGATAAAAATGGCTGTAATCTCTAAGGTTACGTATAGTCTA
TATGATCAAAAAGAGATTAATGCTACAGATATTATCATTAGTCATGTTAAAAATGACGACGATATCGGTACCG
TTAAAGATGGTAGACTAGGTGCTATGGATGGGGCATTATGTAAAACTTGTGGGAAAACGGAATTGGAATGT
TTCGGTCACTGGGGTAAAGTAAGTATTTATAAAACTCATATAGTTAAGCCTGAATTTATTTCAGAAATTATTC
GTTTACTGAATCATATATGTATTCACTGCGGATTATTGCGTTCACGAGAACCGTATTCCGACGATATTAACCTA
AAAGAGTTATCGGGACACGCTCTTAGGAGATTAAAGGATAAAATATTATCCAAGAAAAAGTCATGTTGGAA
CAGCGAATGTATGCAACCGTATCAAAAAATTACTTTTTCAAAGAAAAAGGTTTGTTTCGTCAACAAGTTGG
ATGATATTAACGTTCCTAATTCTCTCATCTATCAAAAGTTAATTTCTATTCATGAAAAGTTTTGGCCATTATTAG
AAATTCATCAATATCCAGCTAACTTATTTTATACAGACTACTTTCCCATCCCTCCGCTGATTATTAGACCGGCT
ATTAGTTTTTGGATAGATAGTATACCCAAAGAAACCAATGAATTAACTTACTTATTAGGTATGATCGTTAAGA
ATTGTAACTTGAATGCTGATGAACAGGTTATCCAGAAGGCGGTAATAGAATACGATGATATTAAAATTATTTC
TAATAACACTACCAGTATCAATTTATCATATATCACATCCGGCAAAAATAATATGATTAGAAGTTATATCGTCGC
CCGGCGAAAAGATCAGACCGCTAGATCTGTAATTGGTCCCAGTACATCTATCACCGTTAATGAGGTAGGAAT
GCCCGCATATATTAGAAATACACTTACAGAAAAGATATTTGTTAATGCCTTTACAGTGGATAAAGTTAAACAA
CTATTAGCGTCAAACCAAGTTAAATTTTACTTTAATAAACGATTAAACCAATTAACAAGAATACGCCAAGGA
AAGTTTATCAAAAATAAAATACATTTATTGCCTGGTGATTGGGTAGAAGTAGCTGTTCAAGAATATACAAGT
ATTATTTTTGGAAGACAGCCGTCTCTACATAGATACAACGTCATCGCTTCATCTATCAGAGCTACCGAAGGA
GATACTATCAAAATATCTCCCGGAATTGCCAACTCTCAAAATGCTGATTTCGACGGGGATGAGGAATGGATG
ATATTAGAACAAATCCTAAAGCTGTAATTGAACAAAGTATTCTTATGTATCCGACGACGTTACTCAAACACG
ATATTCATGGAGCCCCCGTTTATGGATCTATTCAAGATGAAATCGTAGCAGCGTATTCATTGTTTAGGATACA
AGATCTTTGTTTAGATGAAGTATTGAACATCTTGGGGAAATATGGAAGAGAGTTCGATCCTAAAGGTAAAT
GTAAATTCAGCGGTAAAGATATCTATACTTACTTGATAGGTGAAAAGATTAATTATCCGGGTCTCTTAAAGGA
TGGTGAAATTATTGCAAACGACGTAGATAGTAATTTTGTTGTGGCTATGAGGCATCTGTCATTGGCTGGACT
CTTATCCGATCATAAGTCGAACGTGGAAGGTATCAACTTTATTATCAAGTCATCTTATGTTTTTAAGAGATATC
TATCTATTTACGGTTTTGGGGTGACATTCAAAGATCTGAGACCAAATTCGACGTTCACTAATAAATTGGAGG
CCATCAACGTAGAAAAAATAGAACTTATCAAAGAAGCATACGCCAAATATCTCAACGATGTAAGAGACGGG
AAAATAGTTCCATTATCTAAAGCTTTAGAGGCGGACTATGTGGAATCCATGTTATCCAACTTGACAAATCTTA
ATATCCGAGAGATAGAAGAACATATGAGACAAACGCTGATAGATGATCCAGATAATAACCTCCTGAAAATG
GCCAAAGCGGGTTATAAAGTAAATCCTACAGAACTAATGTATATTCTAGGTACGTATGGACAACAAAGGATT
GATGGTGAACCAGCAGAGACTCGAGTATTGGGTAGAGTCTTACCTTACTATCTTCCAGACTCTAAGGATCC
AGAAGGAAGAGGTTACATTCTTAATTCTTTAACAAAAGGATTAACGGGTTCTCAATATTACTTTTCGATGCT
GGTTGCAAGATCTCAATCTACTGATATCGTCTGTGAAACATCACGTACCGGAACACTGGCTAGAAAAATCAT
TAAAAAGATGGAGGATATGGTGGTCGACGGATACGGACAAGTAGTTATAGGTAATACGCTCATCAAGTACG
CCGCCAATTATACCAAAATTCTAGGCTCAGTATGTAAACCTGTAGATCTTATCTATCCAGATGAGTCCATGACT
TGGTATTTGGAAATTAGTGCTCTGTGGAATAAAATAAAACAGGGATTCGTTTACTCTCAGAAACAGAAACT
TGCAAAGAAGACATTGGCGCCGTTTAATTTCCTAGTATTCGTCAAACCCACCACTGAGGATAATGCTATTAA
```

FIG. 11AA

GGTTAAGGATCTGTACGATATGATTCATAACGTCATTGATGATGTGAGAGAGAAATACTTCTTTACGGTATCT
AATATAGATTTTATGGAGTATATATTCTTGACGCATCTTAATCCTTCTAGAATTAGAATTACAAAAGAAACGGC
TATCACTATCTTTGAAAAGTTCTATGAAAAACTCAATTATACTCTAGGTGGTGGAACTCCTATTGGAATTATTT
CTGCACAGGTATTGTCTGAGAAGTTTACACAACAAGCCCTGTCCAGTTTTCACACTACTGAAAAAAGTGGT
GCCGTCAAACAAAAACTTGGTTTCAACGAGTTTAATAACTTGACTAATTTGAGTAAGAATAAGACCGAAAT
TATCACTCTGGTATCCGATGATATCTCTAAACTTCAATCTGTTAAGATTAATTTCGAATTTGTATGTTTGGGAG
AATTAAATCCAGACATCACTCTTCGAAAAGAAACAGATAGGTATGTAGTAGATATAATAGTCAATAGATTATA
CATCAAGAGAGCAGAAATTACCGAATTAGTCGTCGAATATATGATTGAACGATTTATCTCCTTTAGCGTCATT
GTAAAGGAATGGGGTATGGAAACATTCATTGAGGATGAGGATAATATTAGATTTACTGTCTACCTAAATTTC
GTTGAACCGGAAGAATTGAATCTTAGTAAGTTTATGATGGTTCTTCCGGGTGCCGCCAACAAGGGCAAGA
TTAGTAAATTCAAGATTCCTATCTCTGACTATACGGGATATGACGACTTCAATCAAACAAAAAAGCTCAATAA
GATGACTGTAGAACTCATGAATCTAAAAGAATTGGGTTCTTTCGATTTGGAAAACGTCAACGTGTATCCTG
GAGTATGGAATACATACGATATCTTCGGTATCGAGGCCGCTCGTGAATACTTGTGCGAAGCCATGTTAAACA
CCTATGGAGAAGGGTTCGATTATCTGTATCAGCCTTGTGATCTTCTCGCTAGTTTACTATGTGCTAGTTACGA
ACCAGAATCAGTGAATAAATTCAAGTTCGGCGCAGCTAGTACTCTTAAGAGAGCTACGTTCGGAGACAATA
AAGCATTGTTAAACGCGGCTCTTCATAAAAAGTCAGAACCTATTAACGATAATAGTAGCTGCCACTTTTTTA
GCAAGGTCCCTAATATAGGAACTGGATATTACAAATACTTTATCGACTTGGGTCTTCTCATGAGAATGGAAA
GGAAACTATCTGATAAGATATCTTCTCAAAAGATCAAGGAAATGGAAGAAACAGAAGACTTTTAATTCTTAT
CAATAACATATTTTTCTATGATCTGTCTTTTAAACGATGGATTTTCCACAAATGCGCCTCTCAAGTCCCTCATA
GAATGATACACGTATAAAAAATATAGCATAGGCAATGACTCCTTATTTTTAGACATTAGATATGCCAAAATCAT
AGCCCCGCTTCTATTTACTCCCGCAGCACAATGAACCAACACGGGCTCGTTTCGTTGATCACATTTAGATAA
AAAGGCGGTTACGTCGTCAAAATATTTACTAATATCGGTAGTTGTATCATCTACCAACGGTATATGAATAATAT
TAATATTAGAGTTAGGTAATGTATATTTATCCATCGTCAAATTTAAAACATATTTGAACTTAACTTCAGATGATG
GTGCATCCATAGCATTTTTATAATTTCCCAAATACACATTATTGGTTACCCTTGTCATTATAGTGGGAGATTTG
GCTCTGTGCATATCTCCAGTTGAACGTAGTAGTAAGTATTTATACAAACTTTTCTTATCCATTTATAACGTACA
AATGGATAAAACTACTTTATCGGTAAACGCGTGTAATTTAGAATACGTTAGAGAAAAGGCTATAGTAGGCGT
ACAAGCAGCCAAAACATCAACACTTATATTCTTTGTTATTATATTGGCAATTAGTGCGCTATTACTCTGGTTTC
AGACGTCTGATAATCCAGTCTTTAATGAATTAACGAGATATATGCGAATTAAAAATACGGTTAACGATTGGA
AATCATTAACGGATAGCAAAACAAAATTAGAAAGTGATAGAGGTAGACTTCTAGCCGCTGGTAAGGATGAT
ATATTCGAATTCAAATGTGTGGATTTCGGCGCCTATTTTATAGCTATGCGATTGGATAAGAAAACATATCTGC
CGCAAGCTATTAGGCGAGGTACTGGAGACGCGTGGATGGTTAAAAAGGCGGCAAAGGTCGATCCATCTG
CTCAACAATTTTGTCAGTATTTGATAAAACACAAGTCTAATAATGTTATTACTTGTGGTAATGAGATGTTAAAT
GAATTAGGTTATAGCGGTTATTTTATGTCACCGCATTGGTGTTCCGATTTTAGTAATATGGAATAGTGTTAGA
TAAATGCGGTAACGAATGTTCCTGTAAGGAACCATAACAGTTTAGATTTAACGTTAAAGATGAGCATAAACA
TAATAAACAAAATTACAATCAAACCTATAACATTAATATCAAACAATCCAAAAAATGAAATCAGTGGAGTAGT
AAACGCGTACATAACTCCTGGATAACGTTTAGTAGCTGCCGTTCCTATTCTAGACCAAAAATTCGGTTTCAT
GTTTTCGAAACGGTGTTCTGCAACAAGTCGGGGATCGTGTTCTACATATTTGGCGGCATTATCCAGTATCTG
CCTATTGATCTTCATTTCGTTTTCAATTCTGGCTATTTCAAAATAAAATCCCGATGATAGACCTCCAGACTTTA
TAATTTCATCTACGATGTTCAGCGCCGTAGTAACTCTAATAATATAGGCTGATAAGCTAACATCATACCCTCCT
GTATATGTGAATATGGCATGATTTTTGTCCATTACAAGCTCGGTTTTAACTTTATTGCCTGTAATAATTTCTCTC
ATCTGTAGGATATCTATTTTTTTGTCATGCATTGCCTTCAAGACGGGACGAAGAAACGTAATATCCTCAATAA
CGTTATCGTTTCTACAATAACTACATATTCTACCTTTTTATTTTCTAACTCGGTAAAAAAATTAGAATCCCATA
GGGCTAAATGTCTAGCGATATTTCTTTTCGTTTCCTCTGTACACATAGTGTTACAAAACCCTGAAAAGAAGT
GAGTATACTTGTCATCATTTCTAATGTTTCCTCCAGTCCACTGTATAAACGCATAATCCTTGTAATGATCTGGA

FIG. 11AB

```
TCATCCTTGACTACCACAACATTTCTTTTTTCTGGCATAACTTCGTTGTCCTTTACATCATCGAACTTCTGATC
ATTAATATGCTCATGAACATTAGGAAATGTTTCTGATGGAAGTCTATCAATAACTGGCACAACAATAACAGG
AGTTTTCGCCGCCGCCATTTAGTTATTGAAATTAATCATATACAACTCTTTAATACGAGTTATATTTTCGTCTAT
CCATTGTTTCACATTTACATATTTCGACAAAAAGATATAAAATGCGTATTCCAATGCTTCTCTGTTAATGAAT
TACTAAAATATACAAACACGTCACTGTCTGGCAATAAATGATATCTTAGAATATTGTAACAATTTATTTTGTATT
GCACATGTTCGTGATCTATGAGTTCTTCTTCGAATGGCATAGGATCTCCGAATCTGAAAACGTATAAATAGG
AGTTAGAATAATAATATTTGAGAGTATTGGTAATATATAAACTCTTTAGCGGTATAATTAGTTTTTTTCTCTCAA
TTTCTATTTTTAGATGTGATGGAAAAATGACTAATTTTGTAGCATTAGTATCATGAACTCTAATCAAAATCTTA
ATATCTTCGTCACACGTTAGCTCTTTGAAGTTTTTAAGAGATGCATCAGTTGGTTCGACCGATGGAGTAGGT
GCAACAATTTTTTGTTCGATGTATGTATGTACTGGAGCCATTGTTTTAACTATAATGGTGCTTGTATCGAAAA
ACTTTAATGCAGATAGCGGAAGCTCTTCGCCGCGACTTTCTACATCGTAATTGGGTTCTAACGCCGATCTCT
GAATGGATACTAGTTTTCTAAGTTCTAATGTGATTCTCTGAAAATGTAAATCCAATTCCTCCGGCATTATAGAT
GTGTATACATCGGTAAATAAAACTATAGTATCCAACGATCCCTTCTCGCAAATTCTAGTCTTAACCAAAAAATC
GTATATAACCACGGAGATGGCGTATTTAAGAGTGGATTCTTCTACCGTTTTGTTCTTGGATGTCATATAGGAA
ACTATAAAGTCCGCACTACTGTTAAGAATGATTACTAACGCAACTATATAGTTCAAATTAAGCATTTTGGAAA
CATAAAATAACTCTGTAGACGATACTTGACTTTCGAATAAGTTTGCAGACAAACGAAGAAAGAACAGACCT
CTCTTAATTTCAGAAGAAAACTTTTTTTCGTATTCCTGACGTCTAGAGTTTATATCAATAAGAAAGTTAAGAA
TTAGTCGGTTAATGTTGTATTTCATTACCCAAGTTTGAGATTTCATAATATTATCAAAAGACATGATAATATTAA
AGATAAAGCGCTGACTATGAACGAAATAGCTATATGGTTCGCTCAAAAATATAGTCTTGTTAAACGTGGAAA
CGATAACTGTATTTTTAATCACGTCAGCGGCATCTAAATTAAATATAGGTATATTTATTCCACACACTCTACAAT
ATGCCACACCATCTTCATAATAAATAAATTCGTTAGCAAAATTATTAATTTTAGTGAAATAGTTAGCGTCAACT
TTCATAGCTTCCTTCAATCTAATTTGATGCTCACACGGTGCGAATTCCACTCTAACATCCCTTTTCCATGCCTC
AGGTTCATCGATCTCTATAATATCTAGTTTTTTGCGTTTCACAAACACAGGCTCGTCTCTCGCGATGAGATCT
GTATAGTAACTATGTAAATGATAACTAGATAGAAAGATGTAGCTATATAGATGACGATCCTTTAAGAGAGGTA
TAATAACTTTACCCCAATCAGATAGACTGTTGTTATGGTCTTCGGAAAAAGAATTTTTATAAATTTTTCCAGT
ATTTTCCAAATATACGTACTTAACATCTAAAAAATCCTTAATGATAATAGGAATGGATAATCCGTCTATTTTATA
AAGAAATACATATCGCACATTATACTTTTTTTTTGGAAATGGGAATACCGATGTGTCTACATAAATATGCAAAG
TCTAAATATTTTTTAGAGAATCTTAATTGGTCCAAATTCTTTTCCAAGTACGGTAATAGATTTTTCATATTGAA
CGGTATCTTCTTAATCTCTGGTTCTAGTTCCGCATTAAATGATGAAACTAAGTCACTATTTTTATAACTAACGA
TTACATCACCTCTAACATCATCATTTACCAGAATACTGATCTTCTTTTGTCGTAAATACATGTCTAATGTGTTAA
AAAAAAGATCATACAAGTTATACGTCATTTCATCTGTGGTATTCTTGTCATTGAAGGATAAACTCGTACTAAT
CTCTTCTTTAACAGCCTGTTCAAATTTATATCCTATATACGAAAAAATAGCAACCAGTGTTTGATCATCCGCGT
CAATATTCTGTTCTATCGTAGTGTATAACAATCGTATATCTTCTTCTGTGATAGTCGATACGTTATAAAGGTTGA
TAACGAAAATATTTTTATTTCGTGAAATAAAGTCATCGTAGGATTTTGGACTTATATTCGCGTCTAGTAGATAT
GCTTTTATTTTTGGAATGATCTCAATTAGAATAGTCTCTTTAGAGTCCATTTAAAGTTACAAACAACTAGGAA
ATTGGTTTATGATGTATAATTTTTTTAGTTTTTATAGATTCTTTATTCTATACTTAAAAAATGAAAATAAATACA
AAGGTTCTTGAGGGTTGTGTTAAATTGAAAGCGAGAAATAATCATAAATTATTTCATTATCGCGATATCCGTT
AAGTTTGTATCGTAATGGCGTGGTCAATTACGAATAAAGCGGATACTAGTAGCTTCACAAAGATGGCTGAA
ATCAGAGCTCATCTAAAAAATAGCGCTGAAAATAAAGATAAAAACGAGGATATTTTCCCGGAAGATGTAAT
AATTCCATCTACTAAGCCCAAAACCAAACGAGCCACTACTCCTCGTAAACCAGCGGCTACTAAAAGATCAA
CCAAAAAGGAGGAAGTGGAAGAAGAAGTAGTTATAGAGGAATATCATCAAACAACTGAAAAAAAATTCTCC
ATCTCCTGGAGTCAGCGACATTGTAGAAAGCGTGGCCGCTGTAGAGCTCGATGATAGCGACGGGGATGAT
GAACCTATGGTACAAGTTGAAGCTGGTAAAGTAAATCATAGTGCTAGAAGCGATCTTTCTGACCTAAAGGT
GGCTACCGACAATATCGTTAAAGATCTTAAGAAAATTATTACTAGAATCTCTGCAGTATCGACGGTTCTAGA
```

FIG. 11AC

GGATGTTCAAGCAGCTGGTATCTCTAGACAATTTACTTCTATGACTAAAGCTATTACAACACTATCTGATCTA
GTCACCGAGGGAAAATCTAAAGTTGTTCGTAAAAAAGTTAAAACTTGTAAGAAGTAAATGCGTGCACTTTT
TTATAAAGATGGTAAACTCTTTACCGATAATAATTTTTTAAATCCTGTATCAGACGATAATCCAGCGTATGAGG
TTTTGCAACATGTTAAAATTCCTACTCATTTAACAGATGTAGTAGTATATGAACAAACGTGGGAGGAGGCGT
TAACTAGATTAATTTTTGTGGGAAGCGATTCAAAAGGACGTAGACAATACTTTTACGGAAAAATGCATGTAC
AGAATCGCAACGCTAAAAGAGATCGTATTTTTGTTAGAGTATATAACGTTATGAAACGAATTAATTGTTTTAT
AAACAAAAATATAAAGAAATCGTCCACAGATTCCAATTATCAGTTGGCGGTTTTTATGTTAATGGAAACTAT
GTTTTTTATTAGATTTGGTAAAATGAAATATCTTAAGGAGAATGAAACAGTAGGGTTATTAACACTAAAAAA
TAAACACATAGAAATAAGTCCCGATGAAATAGTTATCAAGTTTGTAGGAAAGGACAAAGTTTCACATGAAT
TTGTTGTTCATAAGTCTAATAGACTATATAAACCGCTATTGAAACTGACGGATGATTCTAGTCCCGAAGAATT
TCTGTTCAACAAACTAAGTGAACGAAAGGTATACGAATGTATCAAACAGTTTGGTATTAGAATCAAGGATCT
CCGAACGTATGGAGTCAATTATACGTTTTTATATAATTTTTGGACAAATGTAAAGTCCATATCTCCTCTTCCAT
CACCAAAAAAGTTAATAGCGTTAACTATCAAACAAACTGCTGAAGTGGTAGGTCATACTCCATCAATTTCAA
AAAGAGCTTACATGGCAACGACTATTTTAGAAATGGTAAAGGATAAAAATTTTTTAGATGTAGTATCTAAAA
CTACGTTCGATGAATTCCTATCTATAGTCGTAGATCACGTTAAATCATCTACGGATGGATGATATAGATCTTTA
CACAAATAATTACAAGACCGATAAATGGAAATGGATAAGCGTATGAAATCTCTCGCAATGACCGCTTTCTTT
GGGGAGCTAAGCACATTAGATATTATGGCATTGATAATGTCTATATTTAAACGCCATCCAAACAATACCATTT
TTTCAGTGGATAAGGATGGTCAGTTTATGATTGATTTCGAATACGATAATTATAAGGCTTCTCAATATTTGGA
TCTGACCCTCACTCCGATATTTGGAGATGAATGCAAGACTCACGCATCGAGTATAGCCGAACAATTGGCGT
GTGCGGATATTATTAAAGAGGATATTAGCGAATACATCAAAACTACTCCCCGTCTTAAACGATTTATAAAAAA
ATACCGCAATAGATCAGATACTCGCATCAGTCGAGATACAGAAAAGCTTAAAATAGCTCTAGCTAAAGGCAT
AGATTACGAATATATAAAAGACGCTTGTTAATAAGTAAATGAAAAAAAACTAGTCGTTTATAATAAAACACA
ATATGGATGCCAACATAGTATCATCTTCTACTATTGCAACGTATATAGACGCTTTAGCGAAGAATGCTTCAGA
ATTAGAACAGAGGTCTACCGCATACGAAATAAATAATGAATTGGAACTAGTATTTATTAAGCCGCCATTAATT
ACTTTGACAAATGTAGTGAATATCTCTACGATTCAGGAATCGTTTATTCGATTTACCGTTACTAATAAGGAAG
GTGTTAAAATTAGAACTAAGATTCCATTATCTAAGGTACATGGTCTAGATGTAAAAAATGTACAGTTAGTAGA
TGCTATAGATAACATAGTTTGGGAAAAGAAATCATTAGTGACGGAAAATCGTCTTCACAAAGAATGCTTGTT
GAGACTATCGACAGAGGAACGTCATATATTTTTGGATTACAAGAAATATGGATCCTCTATCCGACTAGAATTA
GTCAATCTTATTCAAGCAAAAACAAAAAACTTTACGATAGACTTTAAGCTAAAATATTTTCTAGGATCCGGT
GCCCAATCTAAAAGTTCTTTGTTGCACGCTATTAATCATCCAAAGTCAAGGCCTAATACATCTCTGGAAATAG
AATTCACACCTAGAGACAATGAAAAAGTTCCATATGATGAACTAATAAAGGAATTGACGACTCTATCACGTC
ATATATTTATGGCTTCTCCAGAGAATGTAATTCTTTCTCCGCCTATTAACGCACCTATAAAGACTTTTATGTTG
CCTAAACAAGATATAGTAGGTCTGGATCTGGAAAATCTATATGCCGTAACTAAGACTGACGGCATTCCTATAA
CTATCAGAGTTACATCAAACGGGTTGTATTGTTATTTTACACATCTTGGTTATATTATTAGATATCCTGTTAAGA
GAATAATAGATTCCGAAGTAGTAGTCTTTGGTGAGGCAGTTAAGGATAAGAACTGGACCGTATATCTCATTA
AGCTAATAGAGCCTGTGAATGCAATCAATGATAGACTAGAAGAAGTAAGTATGTTGAATCTAAACTAGTG
GATATTTGTGATCGGATAGTATTCAAGTCAAAGAAATATGAAGGTCCGTTTACTACAACTAGTGAAGTCGTC
GATATGTTATCTACATATTTACCAAAGCAACCAGAAGGTGTTATTCTGTTCTATTCAAAGGGACCTAAATCTA
ACATTGATTTTAAAATTAAAAAGGAAAATACTATAGACCAAACTGCAAATGTAGTATTTAGGTACATGTCCA
GTGAACCAATTATCTTTGGAGAATCGTCTATCTTTGTAGAGTATAAGAAATTTAGCAACGATAAAGGCTTTC
CTAAAGAATATGGTTCTGGTAAGATTGTGTTATATAACGGCGTTAATTATCTAAATAATATCTATTGTTTGGAA
TATATTAATACACATAATGAAGTGGGTATTAAGTCCGTGGTTGTACCTATTAAGTTTATAGCAGAATTCTTAGT
TAATGGAGAAATACTTAAACCTAGAATTGATAAAACCATGAAATATATTAACTCAGAAGATTATTATGGAAAT
CAACATAATATCATAGTTGAACATTTAAGAGATCAAAGCATCAAAATAGGAGATATCTTTAACGAGGATAAA

FIG. 11AD

CTATCGGATGTGGGACATCAATACGCCAATAATGATAAATTTAGATTAAATCCAGAAGTTAGTTATTTTACGA
ATAAACGAACTAGAGGACCGTTGGGAATTTTATCAAACTACGTCAAGACTCTTCTTATTTCTATGTATTGTTC
CAAAACATTTTTAGACGATTCCAACAAACGAAAGGTATTGGCGATTGATTTTGGAAACGGTGCTGACCTGG
AAAAATACTTTTATGGAGAGATTGCGTTATTGGTAGCGACGGATCCGGATGCTGATGCTATAGCTAGAGGA
AATGAAAGATACAACAAATTAAACTCTGGAATTAAAACCAAGTACTACAAATTTGACTACATTCAGGAAACT
ATTCGATCCGATACATTTGTCTCTAGTGTCAGAGAAGTATTCTATTTTGGAAAGTTTAATATCATCGACTGGC
AGTTTGCTATCCATTATTCTTTTCATCCGAGACATTATGCTACCGTCATGAATAACTTATCCGAACTAACTGCT
TCTGGAGGCAAGGTATTAATCACTACCATGGACGGAGACAAATTATCAAAATTAACAGATAAAAAGACTTT
TATAATTCATAAGAATTTACCTAGTAGCGAAAACTATATGTCTGTAGAAAAAATAGCTGATGATAGAATAGTG
GTATATAATCCATCAACAATGTCTACTCCAATGACTGAATACATTATCAAAAAGAACGATATAGTCAGAGTGT
TTAACGAATACGGATTTGTTCTTGTAGATAACGTTGATTTCGCTACAATTATAGAACGAAGTAAAAAGTTTAT
TAATGGCGCATCTACAATGGAAGATAGACCGTCTACAAAAAACTTTTTCGAACTAAATAGAGGAGCCATTA
AATGTGAAGGTTTAGATGTCGAAGACTTACTTAGTTACTATGTTGTTTATGTCTTTTCTAAGCGGTAAATAAT
AATATGGTATGGGTTCTGATATCCCCGTTCTAAATGCATTAAATAATTCCAATAGAGCGATTTTTGTTCCTATA
GGACCTTCCAACTGTGGATACTCTGTATTGTTAATAGATATATTAATACTTTTGTCGGGTAACAGAGGTTCTA
CGTCTTCTAAAAATAAAAGTTTGATAACATCTGGCCTGTTCATAAATAAAAACTTGGCGATTCTATATATACTC
TTATTATCAAATCTAGCCATTGTCTTATAGATGTGAGCTACTGTAGGTGTACCATTTGATTTTCTTTCTAATACT
ATATATTTCTCTCGAAGAAGTTCTTGCACATCATCTGGGAATAAAATACTACTGTTGAGTAAATCAGTTATTTT
TTTTATATCGATATTGATGGACATTTTTATAGTTAAGGATAATAAGTATCCCAAAGTAGATAACGACGATAACG
AAGTATTTATACTTTTAGGAAATCACAATGACTTTATCAGATCAAAATTAACAAAATTAAAGGAGCATGTATT
TTTTTCTGAATATATTGTGACTCCAGATAAATATGGATCTTTATGCGTCGAATTAAATGGGTCTAGTTTTCAGC
ACGGCGGTAGATATATAGAGGTGGAGGAATTTATAGATGCTGGAAGACAAGTTAGATGGTGTTCTACATCC
AATCATATATCTGAAGATATACCCGAAGATATACACACTGATAAATTTGTCATTTATGATATATACACTTTTGAC
GCTTTCAAGAATAAACGATTGGTATTCGTACAGGTACCTCCGTCGTTAGGAGATGATAGCTATTTGACTAAT
CCGTTATTGTCTCCGTATTATCGTAATTCAGTAGCCAGACAAATGGTCAATGATATGATTTTTAATCAAGATTC
ATTTTTAAAATATTTATTAGAACATCTGATTAGAAGCCACTATAGAGTTTCTAAACATATAACAATAGTTAGAT
ACAAGGATACCGAAGAATTAAATCTAACGAGAATATGTTATAATAGAGATAAGTTTAAGGCGTTTGTATTCG
CTTGGTTTAACGGCGTTTCGGAAAATGAAAAGGTACTAGATACGTATAAAAAGGTATCTAATTTGATATAAT
GAATTCAGTGACTGTATCACACGCGCCATATACTATTACTTATCACGATGATTGGGAACCAGTAATGAGTCAA
TTGGTAGAGTTTTATAACGAAGTAGCCAGTTGGCTGCTACGAGACGAGACGTCGCCTATTCCTGATAAGTT
CTTTATACAGTTGAAACAACCGCTTAGAAATAAACGAGTATGTGTGTGCGGTATAGATCCGTATCCGAAAGA
TGGAACTGGTGTACCGTTCGAATCACCAAATTTTACAAAAAAATCAATTAAGGAGATAGCTTCATCTATATCT
AGATTAACCGGAGTAATTGATTATAAAGGTTATAACCTTAATATAATAGACGGGGTTATACCCTGGAATTATT
ACTTAAGTTGTAAATTAGGAGAAACAAAAAGTCACGCGATCTACTGGGATAAGATTTCCAAGTTACTGCTG
CAGCATATAACTAAACACGTTAGTGTTCTTTATTGTTTGGGTAAAACAGATTTCTCGAATATACGGGCCAAG
TTAGAATCCCCGGTAACTACCATAGTCGGATATCATCCAGCGGCTAGAGACCGCCAATTCGAGAAAGATAG
ATCATTTGAAATTATCAACGTTTTACTGGAATTAGACAACAAGGCACCTATAAATTGGGCTCAAGGGTTTAT
TTATTAATGCTTTAGTGAAATTTTAACTTGTGTTCTAAATGGATGCGGCTATTAGAGGTAATGATGTTATCTTT
GTTCTTAAGACTATAGGTGTCCCGTCAGCGTGCAGACAAAATGAAGATCCAAGATTTGTAGAAGCATTTAA
ATGCGACGAGTTAGAAAGATATATTGAGAATAATCCAGAATGTACACTATTCGAAAGTCTTAGGGATGAGG
AAGCATACTCTATAGTCAGAATTTTCATGGATGTAGATTTAGACGCGTGTCTAGACGAAATAGATTATTTAAC
GGCTATTCAAGATTTTATTATCGAGGTGTCAAACTGTGTAGCTAGATTCGCGTTTACAGAATGCGGCGCCAT
TCATGAAAATGTAATAAAATCCATGAGATCTAATTTTTCATTGACTAAGTCTACAAATAGAGATAAAACAAGT
TTTCATATTATCTTTTTAGACACGTATACCACTATGGATACATTGATAGCTATGAAACGAACACTATTAGAATTA

FIG. 11AE

```
AGTAGATCATCTGAAAATCCACTAACAAGATCGATAGACACTGCCGTATATAGGAGAAAAACAACTCTTCG
GGTTGTAGGTACTAGGAAAAATCCAAATTGCGACACTATTCATGTAATGCAACCACCGCATGATAATATAGA
AGATTACCTATTCACTTACGTGGATATGAACAACAATAGTTATTACTTTTCTCTACAACAACGATTGGAGGAT
TTAGTTCCTGATAAGTTATGGGAACCAGGGTTTATTTCATTCGAAGACGCTATAAAAAGAGTTTCAAAAATA
TTCATTAATTCTATAATAAACTTTAATGATCTCGATGAAAATAATTTTACAACGGTACCACTGGTCATAGATTA
CGTAACACCTTGTGCATTATGTAAAAAACGATCGCATAAACATCCGCATCAACTATCGTTGGAAAATGGTGC
TATTAGAATTTACAAAACTGGTAATCCACATAGTTGTAAAGTTAAAATTGTTCCGTTAGATGGTAATAAACTG
TTTAATATTGCACAAAGAATTTTAGACACTAACTCTGTTTTATTAACCGAACGAGGAGACCATATAGTTTGG
ATTAATAATTCATGGAAATTTAACAGCGAAGAACCCTTGATAACAAAACTAATTTTGTCAATAAGACATCAA
CTACCTAAGGAATATTCAAGCGAATTACTCTGTCCAAGAAAACGAAAGACTGTAGAAGCTAACATACGAGA
CATGTTAGTAGATTCAGTAGAGACCGATACCTATCCGGATAAACTTCCGTTTAAAAATGGTGTATTGGACCT
GGTAGACGGAATGTTTTACTCTGGAGATGATGCTAAAAAATATACGTGTACTGTATCAACCGGATTTAAATT
TGACGATACAAAGTTCGTCGAAGACAGTCCAGAAATGGAAGAGTTAATGAATATCATTAACGATATCCAAC
CATTAACGGATGAAAATAAGAAAAATAGAGAGCTATATGAAAAAACATTATCTAGTTGTTTATGTGGTGCTA
CCAAAGGATGTTTAACATTCTTTTTTGGAGAAACTGCAACTGGAAAGTCGACAACCAAACGTTTGTTAAAG
TCTGCTATCGGTGACCTGTTTGTTGAGACGGGTCAAACAATTTTAACAGATGTATTGGATAAAGGACCTAAT
CCATTTATCGCTAACATGCATTTGAAAAGATCTGTATTCTGTAGCGAACTACCTGATTTTGCCTGTAGTGGAT
CAAAGAAAATTAGATCTGACAATATTAAAAAGTTGACAGAACCTTGTGTCATTGGAAGACCGTGTTTCTCC
AATAAAATTAATAATAGAAACCATGCGACAATCATTATCGATACTAATTACAAACCTGTTTTTGATAGGATAG
ATAACGCATTAATGAGAAGAATTGCCGTCGTGCGATTCAGAACACACTTTTCTCAACCTTCTGGTAGAGAG
GCTGCTGAAAATAATGACGCGTACGATAAAGTCAAACTATTAGACGAGGGGTTAGATGGTAAAATACAAAA
TAATAGATATAGATTCGCATTTCTATACTTGTTGGTGAAATGGTACAGAAAATATCATGTTCCTATTATGAAAC
TATATCCTACACCGGAAGAGATTCCGGACTTTGCATTCTATCTCAAAATAGGTACTCTGTTAGTATCTAGCTCT
GTAAAGCATATTCCATTAATGACGGACCTCTCCAAAAAGGGATATATATTGTACGATAATGTGGTCACTCTTC
CGTTGACTACTTTCCAACAGAAAATATCCAAGTATTTTAATTCTAGACTATTTGGACACGATATAGAGAGCTT
CATCAATAGACATAAGAAATTTGCCAATGTTAGTGATGAATATCTGCAATATATATTCATAGAGGATATTTCAT
CTCCGTAAATATATGCTCATATATTTATAGAAGATATCACATATCTAAATGAATACCGGAATCATAGATTTATTTG
ATAATCATGTTGATAGTATACCAACTATATTACCTCATCAGTTAGCTACTCTAGATTATCTAGTTAGAACTATCAT
AGATGAGAACAGAAGCGTGTTATTGTTCCATATTATGGGATCAGGTAAAACAATAATCGCTTTGTTGTTCGC
CTTGGTAGCTTCCAGATTTAAAAAGGTTTACATTCTAGTGCCTAATATCAACATTTTGAAAATTTTTAATTATA
ATATGGGTGTAGCTATGAACTTGTTTAATGACGAATTCATAGCTGAGAATATCTTTATTCATTCCACAACAAG
TTTTTATTCTCTTAATTATAACGATAACGTCATTAATTATAACGGATTATCTCGCTACAATAACTCTATTTTTATC
GTTGATGAGGCACATAATATCTTTGGGAATAATACTGGAGAACTTATGACCGTGATAAAAAATAAAAACAAG
ATTCCTTTTCTACTATTGTCTGGATCTCCCATTACTAACACACCTAATACTCTGGGTCATATTATAGATTTAATG
TCCGAAGAGACGATAGATTTTGGTGAGATTATTAGTCGTGGTAAGAAAGTAATTCAGACACTTCTTAACGA
ACGCGGTGTGAATGTACTTAAGGATTTGCTTAAAGGAAGAATATCATATTACGAAATGCCTGATAAAGATCT
ACCAACGATAAGATATCACGGACGTAAGTTTCTAGATACTAGAGTAGTATATTGTCACATGTCTAAACTTCAA
GAGAGAGATTATATGATTACTAGACGACAGCTATGTTATCATGAAATGTTTGATAAAAATATGTATAACGTGT
CAATGGCAGTATTGGGACAACTTAATCTGATGAATAATTTAGATACTTTATTTCAGGAACAGGATAAGGAAT
TGTACCCAAATCTGAAAATAAATAATGGCGTGTTATACGGAGAAGAATTGGTAACGTTAAACATTAGTTCCA
AATTTAAATACTTTATTAATCGGATACAGACACTCAACGGAAAACATTTTATATACTTTTCTAATTCTACATATG
GTGGATTGGTAATTAAATATATCATGCTCAGTAATGGATATTCTGAATATAATGGTTCTCAGGGAACTAATCCA
CATATGATAAACGGCAAACCAAAAACATTTGCTATCGTTACTAGTAAAATGAAATCGTCTTTAGAGGATCTAT
TAGATGTGTATAATTCTCCTGAAAACGATGATGGCAGTCAATTGATGTTTTTGTTTTCATCAAACATTATGTCC
```

FIG. 11AF

GAATCCTATACTCTAAAAGAGGTAAGGCATATTTGGTTTATGACTATCCCAGATACTTTTTCTCAATACAACC
AAATTCTTGGACGATCTATTAGAAAATTCTCTTACGCCGATATTTCTGAACCAGTTAATGTATATCTTTTAGCC
GCCGTATATTCCGATTTCAATGACGAAGTAACGTCATTAAACGATTACACACAGGATGAATTGATTAATGTTT
TACCATTTGACATCAAAAAGCTGTTGTATCTAAAATTTAAGACGAAAGAAACGAATAGAATATACTCTATTCT
TCAAGAGATGTCTGAAACGTATTCTCTTCCACCACATCCATCAATTGTAAAAGTTTTATTGGGAGAATTGGT
CAGACAATTTTTTTATAATAATTCTCGTATTAAGTATAACGACTCCAAGTTACTTAAAATGGTTACATCAGTTA
TAAAAAATAAAGAAGACGCTAGGAATTACATAGATGATATTGTAAACGGTCACTTCTTTGTATCGAATAAAG
TATTTGATAAATCTCTTTTATACAAATACGAAAACGATATTATTACAGTACCGTTTAGACTTTCCTACGAACCA
TTTGTTTGGGGAGTTAACTTTCGTAAAGAATATAACGTGGTATCTTCTCCATAAAACTGATGAAATATATAAA
GAAATAAATGTCGAGCTTTGTTACCAATGGATACCTTCCAGTTACATTGGAACCACACGAGCTGACGTTAG
ACATAAAAACTAATATTAGGAATGCCGTATATAAGACGTATCTCCATAGAGAAATTAGTGGTAAAATGGCCAA
GAAAATAGAAATTCGTGAAGACGTGGAATTACCTCTCGGCGAAATAGTTAATAATTCTGTAGTTATAAACGT
TCCGTGTGTAATAACCTACGCGTATTATCACGTTGGGGATATAGTCAGAGGAACATTAAACATCGAAGATGA
ATCAAATGTAACTATTCAATGTGGAGATTTAATCTGTAAACTAAGTAGAGATTCGGGTACTGTATCATTTAGC
GATTCAAAGTACTGCTTTTTTCGAAATGGTAATGCGTATGACAATGGCAGCGAAGTCACTGCCGTTCTAATG
GAGGCTCAACAAGGTATCGAATCTAGTTTTGTTTTTCTCGCGAATATCGTCGACTCATAAAAAAGAGAATAG
CGGTAAGTATAAACACGAATACTATGGCAATAATTGCGAATGTTTTATTCTCTTCGATATATTTTTGATAATATG
AAAAACATGTCTCTCTCAAATCGGACAACCATCTCATAAAATAGTTCTCGCGCGCTGGAGAGGTAGTTGCT
GCTCGTATAATCTCCCCAGAATAATATACTTGCGTGTCGTCGTTCAATTTATACGGATTTCTATAGTTCTCTGTT
ATATAATGCGGTTTTCCATCATGATTAGACGACGACAATAGTGTTCTGAATTTAGATAGTTGATCAGAATGAA
TGTTTATTGGCGTTGGAAAAATTATCCATACAGCGTCTGCAGAGTGGTTGATAGTTGTTCCTAGATATGTAA
AATAATCCAACTTACTAGGCAGCAAATTGTCTAGATAAAATACTGAATCAAACGGTGCAGACGTATTGGCGG
ATCTAATGGAATCCAATTGATTAACTATCTTTTGAAAATATACATTTTTATGATCCAATACTTGTAAGAATATAG
AAATAATGATAAGTCCATCATCGTGTTTTTTTGCCTCTTCATAAGAACTATATTTTTTTTTTATTCCAATGAACAA
GATTAATCTCTCCAGAGTATTTGTACACATCTATCAAGTGATTGGATCCATAATCGTCTTCCTTTCCCCAATATA
TATGTAGTGATGATAACACATATTCATTGGGGAGAAACCCTCCACTTATATATCCTCCTTTAAAATTAATCCTT
ACTAGTTTTCCAGTGTTCTGGATAGTGGTTGGTTTCGACTCATTATAATGTATGTCTAACGGCTTCAATCGCG
CGTTAGAAATTGCTTTTTTAGTTTCTATATTAATAGGAGATAGTTGTTGCGGCATAGTAAAAATGAAATGATA
ACTGTTTAAAAATAGCTCTTAGTATGGGAATTACAATGGATGAGGAAGTGATATTTGAAACTCCTAGAGAAT
TAATATCTATTAAACGAATAAAAGATATTCCAAGATCAAAAGACACGCATGTGTTTGCTGCGTGTATAACAAG
TGACGGATATCCGTTAATAGGAGCTAGAAGAACTTCATTCGCGTTCCAGGCGATATTATCTCAACAAAATTC
AGATTCTATCTTTAGAGTATCCACTAAACTATTACGGTTTATGTACTACAATGAACTAAGAGAAATCTTTAGAC
GGTTGAGAAAAGGTTCTATCAACAATATCGATCCTCACTTTGAAGAGTTAATATTATTGGGTGGTAAACTAG
ATAAAAAGGAATCTATTAAAGATTGTTTAAGAAGAGAATTAAAAGAGGAAAGTGATGAACGTATAACAGTA
AAAGAATTTGGAAATGTAATTCTAAAACTTACAACACGGGATAAATTATTTAATAAAGTATATATAAGTTATTG
CATGGCGTGTTTTATTAATCAATCGTTGGAGGATTTATCGCATACTAGTATTTACAATGTAGAAATTAGAAAG
ATTAAATCATTAAATGATTGTATTAACGACGATAAATACGAATATCTGTCTTATATTTATAATATGCTAGTTAATA
GTAAATGAACTTTTACAGATCTAGTATAATTAGTCAGATTATTAAGTATAATAGACGACTAGCTAAGTCTATTA
TTTGCGAGGATGACTCTCAAATTATTACACTCACGGCATTCGTTAACCAATGCCTATGGTGTCATAAACGAG
TATCCGTGTCCGCTATTTTATTAACTACTGATAACAAAATATTAGTATGTAACAGACGAGATAGTTTTCTCTATT
CTGAAATAATTAGAACTAGAAACATGTCTAGAAAGAAACGATTATTTCTGAATTATTCCAATTATTTGTCCAA
ACAGGAAAGAAGTATACTATCGTCATTTTTTTCTCTAGATCCAGCTACTACTGATAATGATAGAATAGATGCT
ATTTATCCGGGTGGCATACCCAAAAGGGGTGAGAATGTTCCAGAGTGTTTATCCAGGGAAATTAAAGAAG
AAGTTAATATAGACAATTCTTTTGTATTCATAGACACTCGGTTTTTTATTCATGGCATCATAGAAGATACCATT

FIG. 11AG

```
ATTAATAAATTTTTTGAGGTAATCTTCTTTGTCGGAAGAATATCTTTAACGAGTGATCAAATCATTGATACATT
TAAAAGTAATCATGAAATCAAGGATCTAATATTTTTAGATCCGAATTCAGGTAATGGACTCCAATACGAAATT
GCAAAATATGCTCTAGATACTGCAAAACTCAAATGTTATGGCCATAGAGGATGTTATTACGAATCATTAAAAA
AATTAACTGAGGATGATTGATTAGAAAATATAAATTAATTTACCATCGTGTATTTTTATAACGGGATTGTCCG
GCATATCATGTAGATAGTTACCGTCTACATCGTATACTCGACCATCTACGCCTTTAAATCCTCTATTTATTGACA
TTAATCTATTAGAATTGGAATACCAAATATTAGTACCCTCAATTAGTTTATTGGTAATATTTTTTTTAGACGATA
GATCGATGGCTCTTGAAACCAAGGTTTTCCAACCGGACTCATTGTCGATCGGTGAGAAGTCTTTTTCATTA
GCATGAATCCATTCTAATGATGTATGTTTAAACACTCTAAACAATTGGACAAATTCTTTTGATTTGCTTTGAAT
GATTTCAAATAGGTCTTCGTCTACAGTAGGCATACCATTAGATAATCTAGCCATTATAAAGTGCACGTTTACAT
ATCTACGTTCTGGAGGAGTAAGAACGTGACTATTGAGACGAATGGCTCTTCCTACTATCTGACGAAGAGAC
GCCTCGTTCCATGTCATATCTAAAATGAAGATATCATTAATTGAGAAAAAACTAATACCCTCGCCTCCACTAG
AAGAGAATACGCATGTTTTAATGCATTCTCCGTTAGTGTTTGATTCTTGGTTAAACTCAGCCACCGCCTTGAT
TCTAGTATCTTTTGTTCTAGATGAGAACTCTATATTAGAGATACCAAAGACTTTGAAATATAGTAATAAGATTT
CTATTCCTGACTGATTAACAAATGGTTCAAAGACTAGACATTTACCATGGGATGCTAATATTCCCAAACATAC
ATCTATAAATTTGACGCTTTTCTCTTTTAATTCAGTAAATAGAGAGATATCAGCCGCACTAGCATCCCCTTTCA
ATAGTTCTCCCTTTTTAAAGGTATCTAATGCGGATTTAGAAAACTCTCTATCTCTTAATGAATTTTTAAAATCA
TTATATAGTGTTGCTATCTCTTGCGCGTATTCGCCCGGATCACGATTTTGTCTTTCAGGAAAGCTATCGAACG
TAAACGTAGTAGCCATACGTCTCAGAATTCTAAATGATGATATACCTGTTTTTATTTCAGCGAGTTTAGCCTTT
TGATAAATTTCTTCTTGCTTTTTCGACATATTAACGTATCGCATTAATACTGTTTTCTTAGCGAATGATGCAGA
CCCTTCTACGTCATCAAAAATAGAAAACTCGTTATTAACTATGTACGAACATAGGCCTCCTAGTTTGGAGACT
AATTCTTTCTCATCAACTAGACGTTTATTCTCAAATAGCGATTGGTGTTGTAAGGATCCTGGTCGTAGTAAGT
TAACCAACATGGTGAATTCTTGCACACTATTAACGATAGGTGTAGCCGATAAACAAATCATCTTATGGTTTTT
TAATGCGATGGTCTTAGATAAAAAATTATATACTGAACGAGTAGGACGGATCTTACCATCTTCTTTGATTAAT
GATTTAGAAATGAAGTTATGACATTCATCAATAATGACGCATATTCTACTCTTGGAATTAATAGTTTTGATATT
AGTAAAAAATTTATTTCTAAAATTTTGATCATCGTAATTAATAAAAATACAATCCTTCGTTATCTCTGGAGCGT
ATCTGAGTATAGTGTTCATCCAAGGATCTTCTATCAAAGCCTTTTTCACCAATAAGATAATAGCCCAATTCGTA
TAAATATCCTTAAGATGTTTGAGAATATATACAGTAGTCATTGTTTTACCGACACCCGTTTCATGGAACAATA
AAAGAGAATGCATACTGTCTAATCCTAAGAAAACTCTTGCTACAAAATGTTGATAATCCTTGAGGCGTACTA
CGTCCGACCCCATCATTTCAACGGGCATATTAGTAGTTCTGCGCAATGCATAATCGATATAGGCCGCGTGTG
ATTTACTCATTTATGAGTGATAAGTAATAACTATGTTTTAAAAATCACAGCAGTAGTTTAACTAGTCTTCTCTG
ATGTTTGTTTTCGATACTTTTTGAATCAGAAGTCATACTAGAATAAAGCAACGAGTGAACGTAATAGAGAGC
TTCGTATACTCTATTCGAAAACTCTAAGAACTTATTAATGAATTCCGTATCCACTGGATTGTTAAAATACTAA
ATTGAACACTGTTCACATCCTTCCAAGAAGAAGACTTAGTGACGGACTTAACATGAGACATAAATAAATCCA
AATTTTTTTTACAAACATCACTAGCCACCATAATGGCGCTATCTTTCAACCAGCTATCGCTTACGCATTTTAGC
AGTCTAACATTTTTAAAGAGACTACAATATATTCTCATAGTATCGATTACACCTCTACCGAATAAAGTTGGAA
GTTTAATAATACAATATTTTTCGTTTACAAAATCAAATAATGGTCGAAACACGTCGAAGGTTAACATCTTATA
ATCGCTAATGTATAGATTGTTTTCAGTGAGATGATTATTAGATTTAATAGCATCTCGTTCACGTTTGAACAGTT
TATTGCGTGCGCTGAGGTCGGCAACTACGGCGTCCGCTTTAGTACTCCTCCCATAATACTTTACGCTATTAAT
CTTTAAAAATTTCATAGACTTTATCTAGATCGCTTTCTGGTAACATGATATCATGTGTAAAAAGTTTTAACATGT
CGGTCGGCATTCTATTTAGATCATTAACTCTAGAAATCTGAAGAAAGTAATTAGCTCCGTATTCCAGACTAGG
TAATGGGCTTTTACCTAGAGACAGATTAAGTTCTGGCAATGTTTCATAAAATGGAAGAAGGACATGCGTTC
CCTCCCGGATATTTTTTACAATTTCATCCATTTACAACTCTATAGTTTGTTTTCATTATTATTAGTTATTATCTCC
CATAATCTTGGTAATACTTACCCCTTGATCGTAAGATACCTTATACAGGTCATTACATACAACTACCAATTGTTT
TTGTACATAATAGATTGGATGGTTGACATCCATGGTGGAATAAACTACTCGAACAGATAGTTTATCTTTCCCC
```

FIG. 11AH

CTAGATACATTAGCCGTAATAGTTGTCGGCCTAAAGAATATCTTTGGTGTAAAGTTAAAAGTTAGGGTTCTT
GTTCCATTATTGCTTTTTGTCAGTAGTTCATTATAAATTCTCGAGATGGGTCCGTTCTCTGAATATAGAACATC
ATTTCCAAATCTAACTTCTAGTCTAGAAATAATATCGGTCTTATTCTTAAAATCTATTCCCTTGATGAAGGGAT
CGTTAATGAACAAATCCTTGGCCTTTGATTCGGCTGATCTATTATCTCCGTTATAGACGTTACGTTGACTAGT
CCAAAGACTTACAGGAATAGATGTATCGATGATGTTGATACTATGTGATATGTGAGCAAAGATTGTTCTCTTA
GTGGCATCACTATATGTTCCAGTAATGGCGGAAAACTTTTTAGAAATGTTATATATAAAAGAATTTTTTCGTG
TTCCAAACATTAGCAGATTAGTATGAAGATAAACACTCATATTATCAGGAACATTATCAATTTTTACATACACA
TCAGCATCTTGAATAGAAACGATACCATCTTCTGGAACCTCAACAATCTCGGCAGACTCCGGATAACCAGTC
GGTGGGCCATCACTAACAATAACTAGATCATCCAACAATCTACTCACATATGCATCTATATAATCTTTTTCATCT
TGTGAGTACCCTGGATACGAAATAAATTTATTATCCGTATTTCCATAATAAGGTTTAGTATAAACAGAGAGCG
ATGTTGCCGCATGAACTTCAGTTACAGTCGCCGTTGGTTGGTTTATTTGACCTATTACTCTCCTAGGTTTCTC
TATAAACGATGGTTTAATTTGTACATTCTTAACCATATATCCAATAAAGCTCAATTCAGGAACATAAACAAATT
CTTTGTTGAACGTTTCAAAGTCGAACGAAGAGTCACGAATAACGATATCGGATACTGGATTGAAGGTTACC
GTTACGGTAATTTTTGAATCGGATAGTTTAAGACTGCTGAATGTATCTTCCACATCAAACGGAGTTTTAATAT
AAACGTATACTGTAGATGGTTCTTTAATAGTGTCATTAGGAGTTAGGCCAATAGAAATATCATTAAGTTCACT
AGAATATCCAGAGTGTTTCAAAGCAATTGTATTATTGATACAATTATTATATAATTCTTCGCCCTCAATTTCCCA
AATAACACCGTTACACGAAGAGATAGATACGTGATTAATACATTTATATCCAACATATGGTACGTAACCGAAT
CTTCCCATACCTTTAACTTCTGGAAGTTCCAAACTCAGAACCAAATGATTAAGCGCAGTAATATACTGATCCC
TAATTTCGAAGCTAGCGATAGCCTGATTGTCTGGACCATCGTTTGTCATAACTCCGGATAGAGAAATATATTG
CGGCATATATAAAGTTGGAATTTGACTATCGACTGCGAAGACATTAGACCGTTTAATAGAGTCATCCCCACC
GATCAAAGAATTAATGATAGTATTATTCATTTTCTATTTAAAATGGAAAAAGCTTACAATAAACTCCGTAGAG
AAATATCTATAATTTGTGAGTTTTCCTTAAAGTAACAGCTTCCGTAAACGCCGTCTTTATCTCTTAGTAAGTTT
ATTGTATTTATAACCTTTTCCTTATCTTCATAGAATACTAAAGGCAACAAAGAAATTTTTGGTTCTTCTCTAAG
AGCTACGTGAGACTTAACCATAGACGCCAACGAATCCCTACATATTTTAGAACAGAAATACCCAACTTCACC
ACCCTTGAATGTCTCAATACTAATAGGTTTAAAAAACCAAATCTTGATTACAAAACCAACACTTATCAATTACA
CTATTTGTCTTAATAGACACATCTGCCATAGATTTATAATACTTTGGTAGTATACAAGCGAGTGCTTCTTCTTT
AGCGGGCTTAAAGACTGCTTTAGGTGCTGAAATAACCACATCTGGAAGGCTTACTCGCTTAGCCATTTAAT
TACGGAACTATTTTTTTATACTTCTAATGAGCAAGTAGAAAACCTCTCATCTACAAAAACATACTCGTGTCCA
TAATCCTCTACCATAGTTACACGTTTTTTAGATCTCATATGTGCTAAAAAGTTTTCCCATACTAATTGGTTACTA
TTATTTTTCGTATAATTTTTAACAGTTTGAGGTTTTAGATTTTTAGTTACAGAAGTGATATCGAATATTTTATCC
AAAAAGAATGAATAATTAATTGTCTTAGAAGGAGTGTTTTCTTGGCAAAAGAATACCAAGTGCTTAAATATT
TCTACTACTTCATTAATCTTTTCTGTACTCAGATTCAGTTTCTCATCTTTTACTTGATTGATTATTTCAAAGACT
AACTTATAATCCTTTTTATTTATTCTCTCGTTAGCCTTAAGAAAACTAGATACAAAATTTGCATCTACATCATCC
GTGGATATTTGATTTTTTTCCATGATATCCAAGAGTTCCGAGATAATTTCTCCAGAACATTGATGAGACAATA
ATCTCCGCAATACATTTCTCAAATGAATAAGTTTATTAGACACATGGAAGTTTGACTTTTTTTGTACCTTTGTA
CATTTTTGAAATACCGACTCGCAAAAAATACAATATTCATATCCTTGTTCAGATACTATACCGTTGTGTCTACA
ACCGCTACATAATCGTAGATTCATGTTAACACTCTACGTATCTCGTCGTCCAATATTTTATATAAAAACATTTTA
TTTCTAGACGTTGCCAGAAAATCCTGTAATATTTTTAGTTTTTTGGGCTGTGAATAAAGTATCGCCCTAATATT
GTTACCGTCTTCCGCCAATATAGTAGTTAAATTATCCGCACATGCAAAAGAACACCGCTTAGGCGGATTCAG
TACAATGTTATATTTTTCGTACCAACTCATTTAAATATCATAATCTAAAATAGTTCTGTAATATGTCTAGCGCTA
ATATATTGATCATAATCCTGTGCATAAATTAAGATACAACAATGTCTCGAAATCATCGACATGGCTTCTTCCAT
AGTTAGAAGATCGTCGTCAAAGTTAGCAACGTGATTCATCAACATTTGCTGTTTTGAGGCAGCAAATACTG
AACCGTCGCCATTCAACCATTCATAAAAACCATCGTCTGAATCCATTGATAATTTCTTGTACTGGTTTTTGAG
AGCTCGCATCAATCTAGCATTTCTAGCTCCCGGATTGAAAACAGAAAGAGGATCGTACATCCAGGGTCCAT

FIG. 11AI

TTTCTGTAAATAGAATCGTATAATGTCCCTTCAAGAAGATATCAGACGATCCACAATCAAAGAATTGGTCTCC
GAGTTTGTAACAAACTGCGGACTTTAACCTATACATGATACCGTTTAGCATGATTTCTGGTGATACGTCAATC
GGAGTATCATCTATTAGAGATCTAAAGCCGGTGTAACATTCTCCACCAAACATATTCTTATTCTGACGTCGTT
CTACATAAAACATCATTGCTCCATTAACGATAACAGGGGAATGAACAGCACTACCCATCACATTAGTTCCCA
ATGGATCAATGTGTGTAACTCCAGAACATCTTCCATATCCTATGTTAGGAGGAGCGAACACCACTCTTCCAC
TATTGCCATCGAATGCCATAGAATAAATATCCTTGGAATTGATAGAAATCGGACTGTCGGATGTTGTGATCAT
CTTCATAGGATTAACAACTATGTATGGTGCCGCCTGAAGTTTCATATCGTAACTGATGCCGTTTATAGGTCTA
GCCACAGAAACCAACGTAGGTCTAAATCCAACTATAGACAAAATAGAAGCCAATATCTGTTCCTCATCTGTC
ATAACTTGAGAGCATCCAGTATGAATAATCTTCATTAGATGGGGATCTACCGCATCATCATCGTTACAATAAA
AAATTCCCATTCTAATGTTCATAATTGCTTTTCTAATCATGGTATGCATGTTTGCTCTCTGAATCTCTGTGGAA
ATTAGATCTGATACACCTGTAATCACTATCGGATTATCCTCCGTAAGACGATTAACCAACAACATATAATTATA
AGACTTTACTTTTCTAAATTCATAAAGTTGCTGGATTAGGCTATAGGTGTCTCCATGTACATACGCGTTCTCG
AGCGCAGGAAGTTTAATACCGAATAGTGCCATCAGAATAGGATGAATATAGTAATTAGTTTCTGGTTTTCTAT
AAATAAAAGACAAATCTTGTGAACTAGACATATCGGTAAAATGCATGGATTGGAATCGTGTAGTCGACAGA
AGAATATGATGATTAGATGGAGAGTATATTTTATCTAACTCTTTGAGTTGGTCACCGATTCTAGGACTAGCTC
GAGAATGAATAAGTACTAAAGGATGAGTACATTTCACAGAAACACTAGCATTGTTCAATGTGCTCTTTACAT
GGGTAAGGAGTTGAAATAGCTCGTTTCTATTTGTTCTGACAATATTTAGTTTATTCATAATGTTAAGCATATCC
TGAATAGTAAAGTTAGATGTGTCATACTTGTTAGTAGTTAGATATTTAGCAATTGCATTCCCATCATTTCTCAA
TCTCGTACTCCAATCATGTGTAGATGCTACTTCGTCGATGGAAACCATACAATCCTTTTTGATAGGCTGTTGA
GATTGATTATTTCCTGCACGTTTAGGTTTGGTACGTTGATTTCTAGCCCCTGCAGATATAAAGTCATCGTCTA
CAATTTTGGATAATGAATTGCATACACTACAAGACAAAGATTTATCAGAAGTGTGAATATGATCTTCATCTAC
CAAAGAAAGAGTTTGATTAGTATAACTAGATTTTAGTCCTGCGTTAGATGTTAAAAAAACATCGCTATTGAC
CACGGCTTCCATTATTTATATTCGTAGTTTTTACTCGAAAGCGTGATTTTAATATCCAATCTTATTACTTTTGGA
ATCGTTCAAAACCTTTGACTAGTTGTAGAATTTGATCTATTGCCCTACGCGTATACTCCCTTGCATCATATACG
TTCGTCACCAGATCGTTTGTTTCGGCCTGAAGTTGGTGCATATCTTTTTCAACACTCGACATGAGATCCTTA
AGGGCCATATCGTCTAGATTTTGTTGAGATGCTGCTCCTGGATTTGGATTTTGTTGTGCTGTTGTACATACTG
TACCACCAGTAGGTGTAGGAGTACATACAGTGGCCACAATAGGAGGTTGAGGAGGTGTAACCGTTGGAGT
AGTACAAGAAATACTTCCATCCGATTGTTGTGTACATGTAGTTGTTGGTAACGTCTGAGAAGGTTGGGTAG
ATGGCGGTGTCGTCGTCTTTTGATCTTTATTAAATTTAGAGATAATATCCTGAACAGCATTGCTCGGCGTCAA
CGCTGGAAGGAGTGAACTCGCCGGCGCATCAGTATCTGCAGACAGCCAATCAAAAAGATTAGACATATCA
GATGATGTATTAGTTTGTTGTCGTGGTTTTGGTGTAGGAGCAGTACTACTAGGTAGAAGAATAGGAGCCGA
TGTAGGTGTCGGAACCGGAACCGGCTGTGGAGTTATATGAATAGTTGGTTGTAGCGGTTGGATAGGCTGT
CTGCTGGCGGCCATCATATTATCTCTAGCTAGTTGTTCTCGCAACTGTCTTTGATAATACGACTCTTGAGACT
TTAGTCCTATTTCAATCGCTTCATCCTTTTTCGTATCCGGATCCTTTTTTTCAGAATAATAGATTGACGACTTT
GGTGTAGAGGATTCTGCCAGCCCCTGTGAGAACTTGTTAAAGAAGTCCATTTAAGGCTTTAAAATTGAATT
GCGATTATAAGATTAAATGGCAGACACAGACGATATTATCGACTATGAATCCGATGATCTCACTGAATACGA
GGATGATGAAGAAGAGGAAGAAGATGGAGAGTCACTAGAAACTAGTGATATAGATCCCAAATCTTCTTATA
AGATTGTAGAATCAGCATCCACTCATATAGAAGATGCGCATTCCAATCTTAAACATATAGGGAATCATATATCT
GCTCTTAAACGACGCTATACTAGACGTATAAGTCTATTTGAAATAGCGGGTATAATAGCAGAAAGCTATAACT
TGCTTCAACGAGGAAGATTACCTCTAGTTTCAGAATTTTCTGACGAAACGATGAAGCAAAATATGCTACATG
TAATTATACAAGAGATAGAGGAGGGTTCTTGTCCTATAGTCATCGAAAAGAACGGAGAATTGTTGTCGGTA
AACGATTTTGACAAAGATGGTCTAAAATTCCATCTAGACTATATTATCAAAATTTGGAAACTTCAAAAACGAT
ATTAGAATTTATACGAATATCGTTCTCTAAATGTCACAATCAAGTCTCGCATGTTCAGCAATTTATTGTCGTAC
TTTATATCGTGTTCATTAACGATATCTTGCAAAATAGTAATGATTCTATCTTCCTTCGATAGATATTCTTCAGAG

FIG. 11AJ

```
ATTATTGTCTTATATTCTTTCTTGTTATCCGATATGAATTTGATAAGACTTTGAACATTATTAATACCCGTCTGTT
TAATTTTTTCTACAGATATTTTAGTTTTGGCAGATTCTATCGTATCTGTCAATAGACATCCAACATCGACATTC
GACGTCAATTGTCTATAAATCAACGTATAAATTTTAGAAATAACATTAGCGAATTGTTGTGCATTGATGTCGT
TATTCTGAAACAGTATGATTTTAGGTAGCATTTTCTTAACAAAGAGAACGTATTTATTGTTACTCAGTTGAAC
AGATGATATATCCAGATTACTAACGCATCTGATTCCGTATACCAAACTTTCAGAAGAAATGGTGTACAATTGT
TTGTATTCATTCAATGTCTCCTTTTCAGAAATTAGTTTAGAGTCGAATACTGCAATAATTTTCAAGAGATAGTT
TTCATCAGATAAGATTTTATTTAGTGTAGATATGATAAAACTATTGTTTTGTTGGAGAACTTGATACGCCGCG
TTCTCTGTAGTCGACGCTCTCAAATGGGAAACGATCTCCATTATTTTTTTGGAATCGGATACTATATCTTCGG
TATCTTGACGCAGTCTAGTATACATAGAGTTAAGAGAGATTAGAGTTTGTACATTAAGCAACATGTCTCTAAA
TGTGGCTACAAACTTTTCCTTTTTCACATCATCTAGTTTATTATATACCGATTTCACAACGGCACCAGATTTAA
GGAACCAGAATGAAAAACTCTGATAACTACAATATTTCATCATAGTTACGATTTTATCATCTTCTATAGTTGGT
GTAATAGCGCATACCTTTTTCTCCAAGACTGGAACCAACGTCATAAAAATGTTTAAATCAAAATCCATATCAA
CATCTGATGCGCTAAGACCAGTCTCGCGTTCAAGATTATCTTTACTAATGGTGACGAACTCATCGTATAGAAC
TCTAAGTTTGTCCATTATTTATTTACAGATTTAGTTGTTTAATTTATTTGTGCTCTTCCAGAGTTGGGATAGTAT
TTTTCTAACGTCGGTATTATATTATTAGGATCTACGTTCATATGTATCATAATATTAATCATCCACGTTTTGATAA
ATCTATCTTTAGCTTCTGAAATAACGTATTTAAACAAAGGAGAAAAATATTTAGCTACGGCATCAGACGCAA
TAACATTTTTTGTAAATGTAACGTATTTAGACGACAGATCTTCGTTAAAAAGTTTTCCATCTATGTAGAATCCA
TCGGTTGTTAACACCATTCCCGCGTCAGATTGAATAGGAGTTTGAATAGTTTGTTTTGGAAATAGATCCTTC
AATAACTTATAGTTGGGTGGGAAAAAATCGATTTTATCACTAGACTCTTTCTTTTTTACTATCATTACCTCATG
AACTATTTCTTGAATGAGTATATGTATTTTCTTTCCTATATCGGACGCGTTCATTGGAAAATATACCATGTCGTT
AACTATAAGAATATTTTTATCCTCGTTTACAAACTGAATAATATCAGATGTAGTTCGTAAACGAACTATATCAT
CACCAGCACAACATCTAACTATATGATATCCACTAGTTTCCTTTAGCCGTTTATTATCTTGTTCCATATTAGCAG
TCATTCCATCATTTAAGAAGGCGTCAAAAATAATAGGGAGAAATGACATTTTGGATTCTGTTACGACTTTAC
CAAAATTAAGGATATACGGACTTACTATCTTTTTCTCAACGTCAATTTGATGAACACACGATGAAAATGTGCT
TCTATGAGATTGATCATGTAGAAAACAACAAGGGATACAATATTTCCGCATATCATGAAATATATTAAGAAAT
CCCACCTTATTATATTTCCCCAAAGGATCCATGCACGTAAACATTATGCCGTTATCATTAATAAAGACTTCTTT
CTCATCGGATCTGTAAAAGTTGTTACTGATTTTTTTCATTCCAGGATCTAGATAATTAATAATGATGGGTTTTC
TATTCTTATTCTTTGTATTTTGGCATATCCTAGACCAGTAAACAGTTTCCACTTTGGTAAAATCAGCAGACTTT
TGAACGCTATTAAACATGGCATTAATGGCAATAACTAAAAATGTAAAATATTTTTCTATGTTAGGAATATGGTT
TTTCACTTTAATAGATATATGGTTTTTGGCCAAAATGATAGATATTTTTTTATCCGAGGATAGTAAAATATTATT
AGTCGCCGTCTCTATAAAAATGAAGCTAGTCTCGATATCCAATTTTATTCTAGAATTGATAGGAGTCGCCAAA
TGTACCTTATACGTTATATCTCCCTTGATGCGTTCCATTTGTGTATCTATATCGGACACAAGATCTGTAAATAGT
TTTACGTTATTAATCATCACGGTATCGCCGTCGCTAGATAACGCTAATGTACCATCCAAGTCCCAAATGGAGA
GATTTAACTGTTCATCGTTTAGAATAAAATGATTACCGGTCATATTAATAAAGTGTTCATCGTATCTAGATAAC
AACGACTTATAATTAATGTCCAAGTCTTGAACTCGCTGAATGATCTTTTTTAACCCAGTTAGTTTTAGATTGG
TACGAAATATATTGTTAAACTTTGATTCTATAGTAATGTCCAAATCTAGTTGTGGAAATACTTCCATCAACATT
GTTTCAAACTTGATAATATTATTATCTACATCTTCGTACGATCCAAATTCCGGAATAGATGTATCGCACGCTCT
GGCCACCCAGATAACCAAAAAGTCACACGCTCCAGGATATACATTGTATAAAAAGCTATCGTTTTTTAGTAG
GGTTTTTTTCTGCGTGTATACGAAGGGATTAAAAATAGTATTATCAACGTAACTATATTCCAAATTATTCTTAT
GAGAATAGATAATAATATCGTCCTTAATATCTAACAAATTTCCTAAATATCCCTTTAATTGAGTCATTCGAAGC
GTCAATAGAATATGTCTCTTAACTATTTCCGGCTGTTGTATATTTAAATGACTTCGTAAAAAATAATATATGGG
CGACTTCTCATCTATGTAATCATATGGAGTGAGATATAGGGCTCGTTCTACCTCCTGCCCCTTACCCACCTGTA
ATACCAATTGCGGACTTACTATATATCGCATATTTATATCGTGGGGTAAAGTGAAAATCTACTACCGATGATGT
AAGTCTTACAATGTTCGAACCAGTACCAGATCTTAATTTGGAGGCCTCCGTAGAACTAGGGGAGGTAAATA
```

FIG. 11AK

```
TAGATCAAACAACACCTATGATAAAGGAGAATAGCGGTTTTATATCCCGCAGTAGACGTCTATTCGCCCATA
GATCTAAGGATGATGAGAGAAAACTAGCACTACGATTCTTTTTACAAAGACTTTATTTTTTAGATCATAGAG
AGATTCATTATTTGTTCAGATGCGTTGACGCTGTAAAAGACGTCACTATTACCAAAAAAAATAACATTATCGT
GGCGCCTTATATAGCACTTTTAACTATCGCATCAAAAGGATGCAAACTTACAGAAACAATGATTGAAGCATT
CTTTCCAGAACTATATAATGAACATAGTAAGAAATTTAAATTCAACTCTCAAGTATCCATCATCCAAGAAAAA
CTCGGATACCAGTTTGGAAACTATCACGTTTATGATTTTGAACCGTATTACTCTACAGTAGCTCTGGCTATTC
GAGATGAACATTCATCTGGCATTTTTAATATCCGTCAAGAGAGTTATCTGGTAAGTTCATTATCTGAAATAAC
ATATAGATTTTATCTAATTAATCTAAAATCTGATCTTGTTCAATGGAGTGCTAGTACGGGCGCTGTAATTAATC
AAATGGTAAATACTGTATTGATTACAGTGTATGAAAAGTTACAACTGGTCATAGAAAATGATTCACAATTTAC
ATGTTCATTGGCTGTGGAATCAAAACTTCCAATAAAATTACTTAAAGATAGAAATGAATTATTTACAAAATTC
ATTAACGAGTTAAAAAAGACCAGTTCATTCAAGATAAGCAAACGCGATAAGGATACGCTACTAAAATATTTT
ACTTAGGACTGGAGTTAGAATTTATAGACGACTCATTTCGTTTATCATTATTACTACCATCATTATTAGTATTCT
TCTTGTTATCTTGTTCAGAAATATACAGCAATGCTATGCCTAATACTAAATACATTATCATGCTTGCAATGGCTC
TAACAACGACGAACCAAAATGAATTTGGTCGTAGCTTTTGTTCACAAAAATACATAAAGAAATGTCTACATA
AATCTATGGCGCCATTGGCTACTTGAAATAGCGCCAGTCCTCCTACAGATTTTAATATAGCTGTATAACATGA
CATTTATTCATCATCAAAAGAGACAGAGTCACCATCTGTCATATTTAGATTTTTTTTCATGTGTTCAAAGTATC
CTCTACTCATTTCATTATAATAGTTTATCATACTTAGAATTTTAGGACGGATCAATGAGTAAGACTTGACTAGA
TCGTCAGTAGTAATTTGTGCATCGTCTATTCTGCATCCGCTTCGTCGAATAATGTATAGCATCGCTTTGAGATT
CTCCATAGCTATCAAGTCTTTATACAATGACATGGAAATATCTGTGAATACTTTATACTTCTCCAACATCGATG
CCTTAACATCATCGCCTACTTTAGCATTGAAAATACGTTCTATTGTGTAGATGGATGTAACAAGATTTTTAAA
CAACAATGCCATCTTACACGATGATTGCCTCAAGTCTCCAATCGTTTGTTTAGAACGATTAGCTACAGAGTC
CAATGCTTGGCTGACTAGCATATTATTATCTTTAGAAATTGTATTCTTCAATGAGGCGTTTATCATATCTGTGAT
TTCGTTAGTCATATTACAGTCTGACTGGGTTGTAATGTTATCCAACATATCACCTATGGATACGGTACACGTAC
CAGCATTTGTAATAATCCTATCTAAGATGTTGTATGGCATTGCGCAGAAAATATCTTCTCCTGTAATATCTCCA
CTCTCGATAAATCTACTCAGATTATTCTTAAATGCCTTATTCTCTGGAGAAAAGATATCAGTGTCCATCATTTC
ATTAATAGTATACGCAGAAAAGATACCACGAGTATCAATTCTATCCAAGATACTTATCGGTTCCGAGTCACAG
ATAATGGTTTCCTCTCCTTCGGGAGATCCTGCATAGAAATATCTAGGACAATAGTTTCTATACTGTCTGTAACT
CTGATAATCTCTAAAGTCACTAACTGATACCATGAAATTGAGAAGATCAAACGCTGAAGTAATTAATTTTTCT
GCCTCGTTTTTACTACAACTAGTTTTCATCAATGTAGTGACGATGTATTGTTTAGTTACTTTTGGTCTAATACT
GATGATAGAGATATTATTGCTTCCCATAATGGATCTTCTAGTAGTCACCTTAAAGCCCATTGATGCGAATAGC
AGATAGATAAAGTCTTGGTATGACTCCTTTCTAATATAGTACGGACTACCTTTGTCACCCAACTTTATACCCAC
ATAAGCCATAACAACCTCTTTAATAGCCGTTTCATGAGGTTTATCAGCCATGAGCCTGAGTAGTTGGAAGAA
TCTCATGAATCCCGTCTCAGAAAGTCCTATATGCATGATAGATTTATCTTTCCTGGGAAACTCTCGTATAGTCA
TAGATGAAATACTCTTCAAAGTTTCTGAAATAAGATTAGTAACAGTCTTACCTCCGACTACTCTGGGTAACA
AACAAACTCTAATAGGTGTTTTCTCTGCGGAGATAATATCAGAAAGGATAGAGCAATAAGTAGTATTATTGT
GATTATAAAGACCGAATACATAACAGGTAGAATTTATAAACATCATGTCCTGAAGGTTTTTAGACTTGTATTC
CTCGTAATCCATACCGTCCCAAAACATGGATTTGGTAACTTTGATAGCCGTAGATCTTTGTTCCTTCGCCAAC
AGGTTAAAGAAATTAATAAAGAATTTGTTGTTTCTATTTATGTCCACAAATTGCACGTTTGGAAGCGCCACG
GTTACATTCACTGCAGCATTTTGAGGATCGCGAGTATGAAGTACGATGTTATTGTTACTGGTATATCTGGAA
AGAAATCTACCAGTCTAGGAATAAGAGATTGATATCGCATAGAAATAGTAAAGTTTATAATCTCATCATCGAA
GAGCATTTTGTTACCATTGTAATAAATATCCACTCTGTCATATGTATAAATGAAGTACTGTTCAAACATGATGA
GATGTTTATATGTTGGCATAGTAGTGAGATCGACGTTTGGTAATGGCAATGTATTAAGATTAACTCCATAATG
TCTAGCAGCATCTGCGATGTTATAAGCGTCGTCAAAGCGGGGTCGATCTTGTATTGTTATATATTGTCTAACA
CCTATAAGATTATCAAAATCTTGTCTGCTTAATACACCGTTAACAATTTTTGCCTTGAATTCTTTTATTGGTGC
```

FIG. 11AL

```
ATTAATAACATCCTTATAGAGGATGTTAAACAAATAAGTGTTATCAAAGTTAAGATCTGGATATTTCTTTTCTG
CTAGAACATCCATTGAGTCGGAGCCATCTGGTTTAATATAACCACCGATAAATCTAGCTCTGTATTCTGTATCC
GTCAATCTAATATTAAGAAGGTGTTGAGTGAAAGGTGGAAGATCGTAAAAGCTGTGAGTATTAATGATAGG
ATTAGTTTCCGAACTAATGTTAATTGGGGTATTAATAATATCTATATTTCCAGCGTTAAGTGTAACATTAAACA
GTTTTAATTCACGTGAAGTAGTATCAATTAAATAATTAATGCCCAATTTGGATATAGCAGCCTGAAGCTCATC
TTGTTTAGTTACGGATCCTAATGAGTTATTAAGCAATATATCGAACGGATGAACGAAGGTTGTTTTGAGTTT
GTCGCATACTTTGTAATCTAGACATAGATGCGGAAGAACGGTAGAAACTATACGAAATAAATATTCAGAGTC
CTCTAATTGATCAAGAGTAACTATTGACTTAATAGGCATCATTTATTTAGTATTAAATGACGACCGTACCAGTG
ACGGATATACAAAACGATTTAATTACAGAGTTTTCAGAAGATAATTATCCATCTAACAAAAATTATGAAATAA
CTCTTCGTCAAATGTCTATTCTAACTCACGTTAACAACGTGGTAGATAGAGAACATAATGCCGCCGTAGTGT
CATCTCCAGAGGAAATATCCTCACAACTTAATGAAGATCTATTTCCAGATGATGATTCACCGGCCACTATTAT
CGAACGAGTACAACCTCATACTACTATTATTGACGATACTCCACCTCCTACGTTTCGTAGAGAGTTATTAATAT
CGGAACAACGTCAACAACGAGAAAAAAGATTTAATATTACAGTATCGAAAAATGCTGAAGCAATAATGGAA
TCTAGATCTATGATAACTTCTATGCCAACACAAACACCATCCTTGGGAGTAGTTTATGATAAAGATAAAAGAA
TTCAGATGTTAGAGGATGAAGTGGTTAATCTTAGAAATCAACGATCTAATACAAAATCATCTGATAATTTAGA
TAATTTTACCAAAATACTATTTGGTAAGACTCCGTATAAATCAACAGAAGTTAATAAGCGTATAGCCATCGTT
AATTATGCAAATTTGAACGGGTCTCCCTTATCAGTCGAGGACTTGGATGTTTGTTCAGAGGATGAAATAGAT
AGAATCTATAAAACGATTAAACAATATCACGAAAGTAGAAAACGAAAAATTATCGTCACTAACGTGATTATT
ATTGTCATAAATATTATCGAGCAAGCATTGCTAAAACTCGGATTTGAAGAAATCAAAGGACTGAGTACCGAT
ATCACTTCAGAAATTATCGATGTGGAGATCGGAGATGACTGCGATGCTGTAGCATCAAAACTAGGAATCGG
TAACAGTCCGGTTCTTAATATTGTATTGTTTATACTCAAGATATTCGTTAAACGAATTAAAATTATTTAATTTAA
TACATTCCCATATCCAGACAACAATCGTCTGGATTAATCTGTTCCTGTCGTCTCATACCGGACGACATATTAAT
CTTTTTATTAGTGGGCATCTTTTTAGATGGTTTCTTTTTCCCAGCATTAACTGAGTCGATACCTAGAAGATCG
TGATTGATCTCTCCGACCATTCCACGAACTTCTAATTGGCCGTCTCTGACGGTACCATAAACTATTTTACCAG
CATTAGTAACAGCTTGGACAATCTGACCATCCATCGCATTGTACGATGTAGTAGTAACTGTTGTTCTACGTTT
AGGAGCACCAGAAGTATTTTTGGAGCCCTTGGAGGCTGATGTAGAAGAAGACGAGGATTTTGATTTTGGT
TTACATGTAATACATTTTGAACTCTTTGATTTTGTATCACATGCGCCGGCAGTCACATCTGTTTGAGAATTAA
GATTATTGTTGCCTCCTTTGACGGCTGCATCTCCACCGATTTGCGCTAGTAGATTTTTAAGCTGTGGTGTAAT
CTTATTAACTGTTTCGATATAATCATCGTAACTGCTTCTAACGGCTAAATTTTTTTTATCCGCCATTTAGAAGC
TAAAAATATTTTTATTTATGCAGAAGATTTAACTAGATTATACAATGAACTAATATGATCCTTTTCCAGATTATT
TACAAACTTGGTATTTTTTGGTTCTGGAGGAGGCGAATTTAAATTCGGACTTGGATTCAGATTTTGTAAGTT
CTTGATCTTATTATACATCGAGTATAGGATGGCGACAGTAACTGCTACACAAATACCGATCAAAAGAAGAAT
ACCAATCATTTATTGACAATAACTTCACTATTGATCAAGTATGCAATATATCATCTTTTCACTAAATAAGTAGTA
ATAATGATTCAACAATGTCGAGATATATGGACGATAATAATTTAGTTCATGGAAATATCGCTATGATTGGTGTG
AATGACTCCGCTAACTCTGTGGGGTGCGCAGTGCTTTCCCCACATAGAATAAATTAGCATTCCGACTGTGAT
AATAATACCAAGTATAAACGCCATAATACTCAATACTTTCCATGTACGAGTGGGACTGGTAGACTTACTAAAG
TCAATAAAGGCGAAGATACACGAAAGAATCAAAGAATGATTCCAGCGATTAGCACGCCGGAAAAATAAT
TTCCAATCATAAGCATCATGTCCATTTAACTAATAAAAATTTTAAATCGCCGAATGAACAAAGTGGAATATAA
ACCATATAAAAACAATAGTTTGTACTGCAAAAATAATATCTATTTTTGTTTTCGAAGATATGGTAAAATTAAAT
AGTAGTACACAGCATGTTATAACTAACAGCAGCAACGGCTCGTAATTACTTATCATTTACTAGACGAAAAGG
TGGTGGGATATTTTCTTGCTCAAATAATACGAATATATCACCCATCCATTTTATGCGATGTTTATATACTCTAAT
CTTTAATAGATCTATAGACGACGGGTTTACCAACAATATAGATTTTATCGATTCATCTAATTTAAACCCTTCCT
TAAACGTGAATGATCTATTATCTGGCATAACGATGACTCTACCTGATGAATCGGACAATGTACTGGGCCATGT
AGAATAAATTATCAACGAATTATCGTCTACGAACATTTATATCATTTGTTTTAATTTTAGGACGCGAATAAATG
```

FIG. 11AM

GATATAAAATAGAAAATAACAGATATTACAACCAGTGTTATGGCCGCGCCCAACCAGGTAGGCAGTTTTATT
TTATCTTTTACTACAGGTTCTCCTGGATGTACGTCACCAACGGCGGACGTAGTTCTAGTACAATTAGACGTA
AGTTCCGCTTGGGAATTTTTTAACGCTAAAGAGTTAACGTTAATCGTGCACCCAACGTATTTACATCTAGTTC
TTTGAACATCTTGATTATAATATAACCATTTTCTATCTCTAGATTCGTCGGTGCACTCATGTAACCAACATACCC
TAGGTCCTAAATATTTATCTCCGGAATTAGATTTTGGATAATTCGCGCACCAACAATTTCTATTTCCTTTATGA
TCGTTACAAAAGACGTATAATGCCGTATCCCCAAAAGTAAAATAATCAGGACGAATAATTCTAATAAACTCA
GAACAATATCTCGCATCCATATGTTTGGAGCAAATATCGGAATAAGTAGACATAGCCGGTTTCCGTTTTGCA
CGTAACCATTCTAAACAATTGGGGTTTCCAGGATCGTTTCTACAAAATCCAGTCATGAAATCGTCACAATGT
TCTGTCTTGTAATTATTATTAAATATTTTTGGACAGTGTTTGGTATTTGTCTTAGAACAACATTTTGCTACGCT
ATCACTATCGCCCAGGAGATAATCCTTTTTTATAAAATGACATCGTTGCCCGGATGCTATATAATCAGTAGCGT
GTTTTAAATCCTTAATATATTCAGGAGTTACCTCGTTCTGATAATAGATTAATGATCCAGGACGAAATTTGAA
AGAACTACATGGTTCTCCATGAATTAATACATATTGTTTAGCAAATTCAGGAACTATAAAACTACTACAATGA
TCTATCGACATACCATCTATCAAACAAAACTTGGGTTTAATTTCTCCCGGAGATGTTTCATAATAGTACGTATA
ACTTTCTTCTGCAAACTTAACAGCTCTATTATATTCAGGATAATTAAAACCTAATTCCATATATTTGTCTCGTAT
ATCTGCTATTCCTGGTGCTATTTTGATTCTATTAAGAGTAACAGCTGCCCCCATTCTTAATAATCGTCAGTATT
TAAACTGTTAAATGTTGGTATATCAACATCTACCTTATTTCCCGCAGTATAAGGTTTGTTGCAGGTATACTGTT
CAGGAATGGTTACATTTATACTTCTTCTATAGTCCTGTCTTTCGATGTTCATCACATATGCAAAGAACAGAATA
AACAAAATAATGTAAGAAATAATATTAAATATCTGTGAATTCGTAAATACATTGATTGCCATAATAATTACAGC
AGCTACAATACACACAATAGACATTCCCACAGTGTTGCCATTACCTCCACGATACATTTGAGTTACTAAGCAA
TAGGTAATAACTAAGCTAGTAAGAGGCAATAGAAAAGATGAGATAAATATCATCAATATAGAGATTAGAGGA
GGGCTATATAGAGCCAAGACGAACAAAATCAAACCGAGTAACGTTCTAACATCATTATTTTTGAAGATTCCC
AAATAATCATTCATTCCTCCATAATCGTTTTGCATCATACCTCCATCTTTAGGCATAAACGATTGCTGCTGTTCC
TCTGTAAATAAATCTTTATCAAGCACTCCAGCACCCGCAGAGAAGTCGTCAAGCATATTGTAATATCTTAAAT
AACTCATTTATATATTAAAAAATGTCACTATTAAAGATGGAGTATAATCTTTATGCCGAACTAAAAAAAATGAC
TTGTGGTCAACCCCTAAGTCTTTTTAACGAAGACGGGGATTTCGTAGAAGTTGAACCGGGATCATCCTTTA
AGTTTCTGATACCTAAGGGATTTTACGCCTCTCCTTCCGTAAAGACGAGTCTAGTATTCGAGACATTAACAA
CGACCGATAATAAAATCACTAGTATCAATCCAACAAATGCGCCAAAGTTATATCCTCTTCAACGCAAAGTCGT
ATCTGAAGTAGTTTCTAATATGAGGAAAATGATCGAATCAAAACGTCCTCTATACATTACTCTTCACTTGGCG
TGTGGATTTGGTAAGACTATTACCACGTGTTATCTTATGGCTACACACGGTAGAAAAACCGTCATTTGCGTA
CCCAATAAAATGTTAATACATCAATGGAAGACACAGGTAGAGGCAGTCGGATTGGAACATAAGATATCCATA
GATGGAGTAAGTAGTCTATTAAAGGAACTAAAGACTCAAAGTCCGGATGTATTAATAGTAGTCAGTAGACAT
CTGACAAACGATGCCTTTTGTAAATATATCAATAAGCATTATGATTTGTTCATCTTGGATGAATCACATACGTA
TAATCTGATGAACAATACAGCAGTTACAAGATTTTTAGCGTATTATCCTCCGATGATGTGTTATTTTTTAACTG
CTACACCTAGACCATCTAACAGAATTTATTGTAACAGTATTATTAATATTGCCAAGTTATCCGATCTAAAAAAA
ACTATCTATGCGGTAGATAGTTTTTTTGAGCCATATTCCACAGACAATATTAGACATATGATAAAACGATTAG
ATGGACCATCTAATAAATATCATATATATACTGAGAAGTTATTATCTGTAGACGAGCCTAGAAATCAACTTATT
CTTGATACCCTGGTAGAAGAATTCAAGTCAGGAACTATTAATCGCATTTTAGTTATTACTAAACTACGTGAAC
ATATGGTATTCTTCTACAAACGATTATTAGATCTTTTCGGACCAGAGGTTGTATTTATAGGAGACGCCCAAAA
TAGACGTACTCCAGATATGGTCAAATCAATCAAGGAACTAAATAGATTTATATTCGTATCCACCTTATTTTATT
CCGGTACTGGTTTAGATATTCCTAGTTTGGATTCGTTGTTCATTTGCTCGGCAGTAATCAACAATATGCAAAT
AGAGCAATTACTAGGGAGGGTATGTCGAGAAACAGAACTATTAGATAGGACGGTATATGTATTTCCTAACA
CATCCATCAAAGAAATAAAGTACATGATAGGAAATTTCATGCAACGAATTATTAGTCTGTCTGTAGATAAACT
AGGATTTAAACAAAAAAGTTATCGGAAACATCAAGAATCCGATCCCACTTCTGTATGTACAACATCCTCCAG
AGAAGAACGTGTATTAAATAGAATATTTAACTCGCAAAATCGTTAAGAAGTTTAAGCGACGATCCGCATGCT

FIG. 11AN

```
GCGCAGGCCAGTGTATTACCCCTCATAGTATTAATATAATCCAATGATACTTTTGTGATGTCGGAAATCTTAAC
CAATTTAGACTGACAGGCAGAACACGTCATGCAATCATCATCGTCATCGATAACTGTAGTCTTGGGCTTCTT
TTTGCGGCTCTTCATTCCGGAACGCACATTGGTGCTATCCATTTAGGTAGTAAAAAATAAGTCAGAATATGC
CCTATAGCACGATCGTGCAAAACCTGGTATATCGTCTCTATCTTTATCACAATATAGTGTATCGACATCTTTATT
ATTATTGACCTCGTTTATCTTGGAACATGGAATGGGAACATTTTTGTTATCAACGGCCATCTTTGCCTTAATT
CCAGATGTTGTAAAATTATAACTAAACAGTCTATCATCGACACAAATGAAATTCTTGTTTAGACGTTTGTAGT
TTACGTATGCGGCTCGTTCGCGTCTCATTTTTTCAGATATTGCAGGTACTATAATATTAAAAATAAGAATGAA
ATAACATAGGATTAAAAATAAAGTTATCATGACTTCTAGCGCTGATTTAACTAACTTAAAAGAATTACTTAGT
CTGTACAAAAGTTTGAGATTTTCAGATTCTGCGGCTATAGAAAAGTATAATTCTTTGGTAGAATGGGGAACA
TCTACTTACTGGAAAATAGGCGTGCAAAAGGTAGCTAATGTCGAGACGTCAATATCTGATTATTATGATGAG
GTAAAAAATAAACCGTTTAATATTGATCCGGGCTATTACATTTTCTTACCGGTATATTTTGGGAGCGTCTTTAT
TTATTCGAAGGGTAAAAATATGGTAGAACTTGGATCTGGAAACTCTTTTCAAATACCAGATGATATGCGAAG
TGCGTGTAACAAAGTATTAGACAGCGATAACGGAATAGACTTTCTGAGATTTGTTTTGTTAAACAATAGATG
GATAATGGAAGATGCTATATCAAAATATCAGTCTCCAGTTAATATATTTAAACTAGCTAGTGAGTACGGATTA
AACATACCCAAATATTTAGAAATTGAAATAGAGGAAGACACATTATTTGACGACGAGTTATACTCTATTATAG
AACGCTCTTTCGATGATAAATTTCCAAAAATATCCATATCGTATATTAAGTTGGGAGAACTTAGGCGGCAAG
TTGTAGACTTTTTCAAATTCTCGTTCATGTATATTGAGTCCATCAAGGTAGATCGTATAGGAGATAATATTTTT
ATTCCTAGCGTTATAACAAAATCAGGAAAAAAGATATTAGTAAAAGATGTAGACCATTTAATACGATCCAAG
GTTAGAGAACATACATTTGTAAAAGTAAAAAAGAAAAACACATTTTCCATTTTATACGACTATGATGGAAAC
GGAACAGAAACTAGAGGAGAAGTAATAAAACGAATTATAGACACTATAGGACGAGACTATTATGTTAACGG
AAAGTATTTCTCTAAGGTTGGTAGTGCAGGCTTAAAGCAATTGACTAATAAATTAGATATTAATGAGTGCGC
AACTGTCGATGAGTTAGTTGATGAGATTAATAAATCCGGAACTGTAAAACGAAAAATAAAAAACCAATCAG
CATTTGATTTAAGCAGAGAATGTTTGGGATATCCAGAAGCGGATTTTATAACGTTAGTTAATAACATGCGGT
TCAAAATAGAAAATTGTAAGGTTGTAAATTTCAATATTGAAAATACTAATTGTTTAAATAACCCGAGTATTGA
AACTATATATGGAAACTTTAACCAGTTCGTCTCAATCTTTAATATCGTCACCGATGTCAAAAAAAGATTATTC
GAGTGAAATAATATGCGCCTTTGATATAGGTGCAAAAAATCCTGCCAGAACTGTTTTAGAAGTCAAGGATA
ACTCCGTTAGGGTATTGGATATATCAAAATTAGACTGGAGTTCTGATTGGGAAAGGCGCATAGCTAAAGATT
TGTCACAATATGAATACACTACAGTTCTTCTAGAACGTCAGCCTAGAAGGTCGCCGTATGTTAAATTTATCTA
TTTTATTAAAGGCTTTTTATATCATACATCGGCTGCCAAAGTTATTTGCGTCTCGCCTGTCATGTCTGGTAATT
CATATAGAGATCGAAAAAAGAGATCGGTCGAAGCATTTCTTGATTGGATGGACACATTCGGATTGCGAGAC
TCCGTTCCGGATAGACGCAAATTAGACGATGTAGCGGATAGTTTCAATTTGGCTATGAGATACGTATTAGAT
AAATGGAATACTAATTATACACCTTATAATAGGTGTAAATCTAGAAATTACATAAAAAAAATGTAATAACGTTA
GTAACGCCATTATGGATAATCTATTTACCTTTCTACATGAAATAGAAGATAGATATGCCAGAACTATTTTTAAC
TTTCATCTAATAAGTTGCGATGAAATAGGAGATATATATGGTCTTATGAAAGAACGCATTTCCTCAGAGGATA
TGTTTGATAATATAGTGTATAATAAAGATATACATCCTGCCATTAAGAAACTAGTGTATTGCGACATCCAACTT
ACTAAACACATTATTAATCAGAATACGTATCCGGTATTTAACGATTCTTCACAAGTGAAATGTTGTCATTATTT
CGACATAAACTCAGATAATAGCAATATTAGCTCTCGTACAGTAGAGATATTTGAGAGGGAAAAGTCATCTCT
TGTATCATATATTAAAACTACCAATAAGAAGAGAAAGGTCAATTACGGCGAAATAAAGAAAACTGTTCATGG
AGGCACTAATGCAAATTACTTTTCCGGTAAAAAGTCTGACGAGTATCTGAGTACTACAGTTAGATCCAACAT
TAATCAACCTTGGATCAAAACCATCTCTAAGAGGATGAGAGTTGATATCATTAATCACTCTATAGTAACGCGT
GGAAAAAGCTCTATATTACAAACTATAGAAATTATTTTTACTAATAGAACATGTGTGAAAATATTCAAGGATT
CTACTATGCACATTATTCTATCCAAGGACAAGGATGAAAAGGGGTGTATACACATGATTGACAAATTATTCTA
TGTCTATTATAATTTATTTCTGTTGTTCGAGGATATCATCCAAAACGAGTACTTTAAAGAAGTAGCTAATGTTG
TAAACCACGTACTCACGGCTACGGCATTAGATGAGAAATTATTCCTAATTAAGAAAATGGCTGAACACGATG
```

FIG. 11AO

TTTATGGAGTTAGCAATTTCAAAATAGGGATGTTTAACCTGACATTTATTAAGTCGTTGGATCATACCGTTTT
CCCCTCTCTGTTAGATGAGGATAGCAAAATAAAGTTTTTTAAGGGGAAAAAGCTCAATATTGTAGCATTACG
ATCTCTGGAGGATTGTATAAATTACGTGACTAAATCCGAGAATATGATAGAAATGATGAAGGAAAGATCGAC
TATTTTAAATAGCATAGATATAGAAACGGAATCGGTAGATCGTCTAAAAGAATTGCTTCTAAAATGAAAAAA
AACACTGATTCAGAAATGGATCAACGACTCGGATATAAGTTTTTGGTGCCTGATCCTAAAGCCGGAGTTTT
TTATAGACCGTTACATTTCCAATATGTATCGTATTCTAATTTTATATTGCATCGATTGCATGAAATCTTGACCGT
CAAGCGGCCACTCTTATCGTTTAAGAATAATACAGAACGAATTATGATAGAAATTAGCAATGTTAAAGTGAC
TCCTCCAGATTACTCACCTATAATCGCGAGTATTAAAGGTAAGAGTTATGACGCATTAGCCACGTTCACTGTA
AATATCTTTAAAGAGGTAATGACCAAAGAGGGTATATCCATCACTAAAATAAGTAGTTATGAGGGAAAAGAT
TCTCATTTGATAAAAATTCCGCTACTAATAGGATACGGGAATAAAAATCCACTTGATACAGCCAAGTATCTTG
TTCCTAATGTCATAGGTGGAGTCTTTATCAATAAACAATCTGTCGAAAAAGTAGGAATTAATCTAGTAGAAA
AGATTACAACATGGCCAAAATTTAGGGTTGTTAAGCCAAACTCATTCACTTTCTCGTTTTCCTCCGTATCCCC
TCCTAATGTATTACCGACAAGATATCGCCATTACAAGATATCTCTGGATATATCACAATTGGAAGCGTTGAATA
TATCATCGACAAAGACATTTATAACGGTCAATATTGTTTTGCTGTCTCAATATTTATCTAGAGTGAGTCTAGAA
TTCATTAGACGTAGTTTATCATACGATATGCCTCCAGAAGTTGTCTATCTAGTAAACGCGATAATAGATAGTGC
TAAACGAATTACTGAATCTATTACTGACTTTAATATTGATACATACATTAATGACCTGGTGGAAGCTGAACAC
ATTAAACAAAAATCTCAGTTAACGATTAACGAGTTCAAATATGAAATGCTGCATAACTTTTTACCTCATATGA
ACTATACACCCGATCAACTAAAGGGATTTTATATGATATCTTTACTAAGAAAGTTTCTCTACTGTATCTTCCAC
ACTTCTAGATATCCAGATAGAGATTCGATGGTTTGTCATCGCATCCTAACGTACGGCAAATATTTTGAGACGT
TGGCACATGATGAATTAGAGAATTACATAGGCAACATCCGAAACGATATCATGAACAATCACAAGAACAGA
GGCACTTACGCGGTAAACATTCATGTACTAACAACTCCCGGACTTAATCACGCGTTTTCTAGCTTATTGAGT
GGAAAGTTCAAAAAGTCAGACGGTAGTTATCGAACACATCCTCACTATTCATGGATGCAGAATATTTCTATT
CCTAGGAGTGTTGGATTTTATCCGGATCAAGTAAAGATTTCAAAGATGTTTTCTGTCAGAAAATACCATCCA
AGTCAATATCTTTACTTTTGTTCATCAGACGTTCCGGAAAGAGGTCCTCAGGTAGGTTTAGTATCTCAATTGT
CTGTCTTGAGTTCCATTACAAATATACTAACGTCTGAGTATTTGGATTTGGAAAAGAAAATTTGTGAGTATAT
CAGATCATATTATAAAGATGATATAAGTTACTTTGAAACAGGATTTCCAATCACTATAGAAAATGCTCTAGTC
GCATCTCTTAATCCAAATATGATATGTGATTTTGTAACTGACTTTAGACGTAGAAAACGGATGGGATTCTTCG
GTAACTTGGAGGTAGGTATTACTTTAGTTAGGGATCACATGAATGAAATTCGCATTAATATTGGAGCGGGAA
GATTAGTCAGACCATTCTTGGTTGTGGATAACGGAGAGCTCATGATGGATGTGTGTCCGGAGTTAGAAAGC
AGATTAGACGACATGACATTCTCTGACATTCAGAAAGAGTTTCCGCATGTCATCGAAATGGTAGATATAGAA
CAATTTACTTTTAGTAACGTATGTGAATCGGTTCAAAAATTTAGAATGATGTCAAAGGATGAAAGAAAGCA
ATACGATTTATGTGACTTTCCTGCCGAATTTAGAGATGGATATGTGGCATCTTCATTAGTGGGAATCAATCAC
AATTCTGGACCCAGAGCTATTCTTGGATGTGCTCAAGCTAAACAAGCTATCTCTTGTCTGAGTTCGGATATA
CGAAATAAAATAGACAATGGAATTCATTTGATGTATCCAGAGAGGCCAATCGTGATTAGTAAGGCTTTAGAA
ACTTCAAAGATTGCGGCTAATTGCTTCGGCCAACATGTTACTATAGCATTAATGTCGTACAAAGGTATCAATC
AAGAGGATGGAATTATCATCAAAAAACAATTTATTCAGAGAGGCGGTCTCGATATAGTTACCGCAAAGAAA
CATCAAGTAGAAATTCCATTGGAAAACTTTAATAACAAAGAAAGAGATAGGTCTAACGCCTATTCAAAATTA
GAAAGTAATGGATTAGTTAGACTGAATGCTTTCTTGGAATCCGGAGACGCTATGGCACGAAATATCTCATCA
AGAACTCTTGAAGATGATTTTGCTAGAGATAATCAGATTAGCTTCGATGTTTCCGAGAAATATACCGATATGT
ACAAATCTCGCGTTGAACGAGTACAAGTAGAACTTACTGACAAAGTTAAGGTACGAGTATTAACCATGAAA
GAAAGAAGACCCATTCTAGGAGACAAATTTACCACTAGAACGAGTCAAAAGGGAACAGTCGCGTATGTCG
CGGATGAAACGGAACTTCCATACGACGAAAATGGTATCACGCCAGATGTCATTATTAATTCTACATCCATCTT
CTCTAGAAAAACTATATCTATGTTGATAGAAGTTATTTTAACAGCCGCATATTCTGCTAAGCCGTACAACAATA
AGGGAGAAAACCGACCTGTCTGTTTTCCTAGTAGTAACGAAACATCCATCGATACATATATGCAATTCGCTA

FIG. 11AP

```
AACAATGTTATGAGCATTCAAATCCGAAATTGTCTGATGAAGAATTATCGGATAAAATCTTTTGTGAAAAGA
TTCTCTATGATCCTGAAACGGATAAGCCTTATGCATCCAAAGTATTTTTTGGACCAATTTATTACTTGCGTCTG
AGACATTTAACTCAGGACAAGGCAACCGTTAGATGTAGAGGTAAAAAGACGAAGCTCATTAGACAGGCG
AATGAGGGACGAAAACGTGGAGGAGGTATCAAGTTCGGAGAAATGGAGAGAGACTGTTTAATAGCGCAT
GGCGCAGCCAATACTATTACAGAAGTTTTGAAAGATTCGGAAGAAGATTATCAAGATGTGTATGTTTGTGA
AAATTGTGGAGACATAGCAGCACAAATCAAGGGTATTAATACATGTCTTAGATGTTCAAAACTTAATCTCTCT
CCTCTCTTAACAAAAATTGATACCACGCACGTATCTAAAGTATTTCTTACTCAAATGAACGCCAGAGGCGTA
AAAGTCAAATTAGATTTCGAACGAAGACCTCCTTCGTTTTATAAACCATTAGATAAAGTTGATCTCAAGCCG
TCTTTTCTGGTGTAATATTCTAGTTTGGTAGTAGATACATATCAATATCATCAAATTCGAGATCCGAATTATAAA
ATGGGCGTGGATTGTTAACTATAGAATCGGACGTCTGATATTCGAAAATCTGTGGAGTTTCAGGTTTTGGTG
GAGGTGTAACTGCTACTTGGGATACTGAAGTCTGATATTCAGAAAGCTGTGGATGTTCTGGTTCGGCATCC
ACCGATGGTGTCACATCACTAATCGGTTCGGTAACGTCTGTGGATGGAGGTGCTACTTCTACAGAACCTGTA
GCCTCAGTTGTCAACGGAGATACATTTTTAATGCGAGAAAATGTATAATTTGGTAATGGTTTCTCATGTGGA
TCTGAAGAAGAGGTAAGATATCTACTAGAAAGATACCGATCACGTTCTAGTTCTCTTTTGTAGAACTTAACT
TTTTCTTTCTCCGCATCTAGTTGATATTCCAACCTCTTCACGTTACTACGTTCAGATTCCAATTCACGTTCGCA
TGGGTTACCTCCGCAGTTTTTACGAGCGATTTCACGTTCAGCCTTCATGCGTCTCTCCCTCTCTCTATCGAGT
TTATCAGAGCAGTCTTTCTGAAGGCGATCGAACTCCATAAATTTCTCCAACGCTTTGATTGTTTCCATAGATT
TCCGAACTTCAGCTTCTAGGACGGCGATTCTTTTTCTTTCGAATTCACAGCTGGATGTACAACCGTTTCCAT
TACCGCCATCTCTAAGTTTCTTTTCTAGATCGGCAACATTTCATCCCCATGCCTTTTACATTCCTCGAGTCTAC
TGTCGTCGAAATATCGTTCCAGCTCCTTTTCGACATCAATAACTTTAGCACGTTGTCTCTCAAGCTCTCTTTT
GTAGTTATCTGATTCCCTGGCACGTTTAAGATCTTCATGCAATTGAGTCAGCTCTTAACTTCCTCTCTTGCTTC
TTCGTCATAGTACGCGCAATCACTGTGAGATCCATTGTTACCACGTCTACACTCGGCGAGCTCGCGTTTAAG
AGATTCAATTTCCCGTTTGTATTGGTCCATGTTTCCATTGCTACCACCATTAGATTTACAGGCTGCTAGTTGTC
GTTCGAGATCAGAAATACGGGTTTTCTTGGAATTGATTTCGTCGATGTACTTGGCATCGAAACACTTATTAA
GTTCTTTTTCCAATTCTACGATTTTATTTCTTTCGCGAGTCAATTCCCTCCTGTAGTAACTATCTGTTTTGTCA
GATTCACGCTCTCTACGTAGACTTTCTTGCAAGTTACTAATTTGTTCCCTAGCACGTCCGAGTTTAGTTTTAT
ATGCTGAATAGAGTTCTGATTCATCCTTTGAGCAGATCTCTAGCGATCGTTTAAGATTCCTGATTCTAGTCTT
TAGCCTATTTACCTCCTCAGAAGATGTTCCGTTACCGTTGCGTTTACACTCGTTAAGCTGTCTATCAAGATCC
ATGATTCTATCTCTAAGACGTTGCATCTCTCTTTCCATATCAGCATTGCTTTCATTATTACGTCTGCAGTCACTC
AACTGTCTTTCAATATCTGAGATTCTATCTCTAAGACGTCGCATCTCTCTCTGTTTCAGCATTGGTTTCATTAT
TACGTCTACAGTCGTTCAACTGTCTTTCAAGATCTGATATTCTAGATTGGAGTCTGCTAATCTCTGTAGCATTT
TCACGGCATTCACTCAGTTGTCTTTCAAGATCTGAAATTTTAGATTGGAGTCTGCTAATCTCTGTAAGATTTC
CTCCTCCGCTCTCGATGCAGTTGGTCAACTTATTCTCTAGTTCTCTAATACGCGAACGCAGTGCATCAACTTC
TTGCGTGTCTTCCTGGTTGCGTGTACATTCATCGAGTCTAGATTCGAGATCTCTAACGCGTCGTCGTTCTTCC
TCAAGTTCTCTGCGTACTACAGAAAGCGTGTCCCTATCTTGTTGATATTTAGCAATTTCTGATTCTAGAGTAC
TGATTTTGCTTACGTAGTTACTAATAGTTGTCTTGGCCTTATCAAGATCCTCCTTGTATTTGTCGCATTCCTTG
ATATCCCTACGAAGTCTGGACAGTTCCCATTCGACATTACGACGTTTATCGATTTCAGCTCGGAGATCGTCAT
CGCGTTGTTTTAGCCACATACGACTGAGTTCAAGTTCTCGTTGACAAGATCCATCTACTTTTCCATTCCTAAT
AGTATCCAGTTCCTTTTCTAGTTCTGAACGCATTTCTCGTTCCCTATCAAGCGATTCTCTCAATTCTCGGATAG
TCTTCTTATCAATTTCTAATAAATCTGAACCATCATCTGTCCCATTTTGAATATCCCTGTGTTCTTTGATCTCTTT
TGTAAGTCGGTCGATTCTTTCGGTTTTATAAACAGAATCCCTTTCCAAAGTCCTAATCTTACTGAGTTTATCA
CTAAGTTCTGCATTCAATTCGGTGAGTTTTCTCTTGGCTTCTTCCAACTCTGTTTTAAACTCTCCACTATTTCC
GCATTCTTCCTCGCATTTATCTAACCATTCAATTAGTTTATTAATAACTAGTTGGTAATCAGCGATTCCTATAGC
CGTTCTTGTAATTGTGGGAACATAATTAGGATCTTCTAATGGATTGTATGGCTTGATAGCATCATCTTTATCAT
```

FIG. 11AQ

```
TATTAGGGGGATGGACAACCTTAATTGGTTGGTCCTCATCTCCTCCAGTAGCGTGTGGTTCTTCAATACCAG
TGTTAGTAATAGGCTTAGGCAAATGCTTGTCGTACGCGGGCACTTCCTCATCCATCAAGTATTTATAATCGGG
TTCTACTTCAGAATATTCTTTTCTAAGAGACGCGACTTCGGGAGTTAGTAGAAGAACTCTGTTTCTGTATCTA
TCAACGCTGGAATCAATACTCAAGTTAAGGATAGCGAATACCTCATCGTCATCATCCGTATCTTCTGAAACAC
CATCATATGACATTTCATGAAGTCTAACGTATTGATAAATAGAATCAGATTTAGTATTAAACAGATCCTTAACC
TTTTTAGTAAACGCATATGTATATTTTAGATCTCCAGATTTCATAATATGATCACATGCCTTAAATGTCAGTGCT
TCCATGATATAATCTGGAACACTAATGGGTGACGAAAAAGATACAGCACCATATGCTACGTTGATAAATAAAT
CTGAACCACTAAGTAGATAATGATTAATGTTAAGGAAAAGAAAATATTCAGTGTATAGGTATGTCTTGGCGT
CATATCTTGTACTAAACACGCTAAACAGTTTGTTAATGTGATCAATTTCCAATAGATTAATTAGAGCAGCGGG
AATACCAACAAACATATTACCACATCCGTATTTTCTATGAATATCACATATCATGTTAAAAAATCTTAATAGAAG
AGCGAATATCTCGTCTGACTTAATGAGACGTAGTTCAGCAGCAACATAAGTCATAACTGTAAATAGAACATA
CTTTCCTGTAGTGTTGATTCTAGACTCCACATCAACACCATTATTAAAAATAGTTTTATATACATCTTTAATCTG
CTCTCCGTTAATCGTCGAACGTTCTAGTATACGGAAACACTTTGATTTCTTATCTGTAGTTAATGACTTAGTG
ATATCACGAAGAATATTACGAATTACATTTCTTGTTTTTCTTGAGAGACCTGATTCAGAACTCAACTCATCGT
TCCATAGTTTTTCTACCTCAGTGGCGAAATCTTTGGAGTGCTTGGTACATTTTTCAATAAGGTTCGTGACCTC
CATTTATTATAAAAAATTTATTCAAAACTTAACTACAATCGGGTAATTATAAGATCGTAAATCTCCCATGTGGC
GGAATACTACCATCTATCGCATGTGGATGGACAGTAGGTAATGGCCATGGGAACAGTAATGATTGCATATTT
ATCTTTCTTGCTAGTATTACTGCATATTGTCCCAATGTTTCGATGTGATGTTCTAACCTATCAACTGCCGCTGT
ATCACAACAATAGTGTCCGATGAAATTAAGATTATGATCCAATGTGTTTAATATATGATTATCAAGTCTTATAC
GATCCGCGTCTTTTTTGACAGGATCAGGTTCTTCTACAGGAAGAAGTTTCGGCCTCTTATGATATTCATGTC
TGGGAAACGGTGGTCTAGGGTGAGGCTCCGGTATCGGAGTGGGTTTTGGATTATAATCATCATCGTCTATG
ACATCATCATCATCTTCGACTTCGATATTTATTTTGCTATCTTGATGATGTCCTGTATCAGTTGCATTTTCAGCA
CTCGACTGAATATTAGCGCATTCATTGTCTATTATTACCATATTTCTAAACCCAAAATGTATGTGTTGAACATC
AGTACTATCGTTGATGAGTCTTATAGCATGAATTCGCTTATCGTTATCGGGTTTATCTTCTGTCACCTTAGCAA
TTCCTTTTTTATTAAACTCTACATAATCATATCCATTTCTATTGTTTGTTCTAATATAAACGAGTATAGCATCATT
GCTAAATTTTTCAATAGTATCGAAAACAGAATATCCTAAACCATATAATATATATTCAGGGACACTCAAACTAA
ATGTCCAGGATTCTCCTAAATACGTAAACTTTAATAGTGCGAAATCATTCAAAAATCTACCACTTATAGATAG
ATAGTACATAAATGCGTATAGTAGTCTACCTATCTCTTTATTATGAAAACCGGCATTACGATCATATATGTCGTG
ATATACCTGTGATCCGTTTACGTTAAACCATAAATACATGGGTGATCCTATAAACATGAATTTATTTCTAATTCT
CAGAGCTATAGTTAATTGACCGTGTAATATTTGCTTACATGCATACTTGATACGCTCATTAATAAAATTTTTATC
ATTGCTCGTTATCTCAGAATCGTATATATAAGGAGTACCATCGTGATTCTTACCAGATATTATACAAAATACTAT
ATATAAAATATATTGACCAACGTTAGTAATCATATAAATGTTTAACGTTTTAAATTTTGTATTCAATGATCCATT
ATCATACGCTAGCATGGTCTTATGATATTCATTCTTTAAAATATAATATTGTGTTAGCCATTGCATTGGGGCTCC
TAATGGAGATTTTTTATTCTCATCCATTTTAGGATAGGCTTTCATAAAGTCCCTAATAACTTCGTGAATAATGT
TTCTATGTTTTCTACTGATGCATGTATTTGCTTCGATTTTTTTATCCCATGTTTCATCTATCATAGATTTAAACGC
AGTAATGCTCGCAACATTAACATCTTGAACCGTTGGTACAATTCCGTTCCATAAATTTATAATGTTCGCCATTT
ATATAACTCATTTTTTGAATATACTTTTAATTAACAAAGAGTTAAGTTACTCATATGGGCGCCGTCCAGTCTG
AACATCAATCTTTTTAGCCAGAGATATCATAGCCGCTCTTAGAGTTTCAGCGTGATTTTCCAACCTAAATAGA
ACTTCATCGTTGCGTTTACAACACTTTTCTATTTGTTCAAACTTTGTTGTTACATTAGTAATCTTTTTTTCCAA
ATTAGTTAGCCGTTGTTTGAGAGTTTCCTCATTGTCGTCTTCATCGGCTTTAACAATTGCTTCGCGTTTAGCC
TCTGGCTTTTTAGCAGCCTTTGTAGAAAAAAATTCAGTTGCTGGAATTGCAAGATCGTCATCTCCGGGGAA
AAGAGTTCCGTCCATTTAAAGTACAGATTTTAGAAACTGACACTCTGCGTTATTTATATTTGGTACAACACAT
GGATTATAAATATCGATGTTAATAACATCAGAAAATGTAAAGTCTATACATTGTTGCATCGTGTTAAATTTTCT
AATGGATCTAGTATTATTGGGTCCAACTTCTGCCTGAAATCCAAATATGGAAGCGGATACAAAACCGTTTCC
```

FIG. 11AR

TGGATAAACCACACATCTCCACTTTTGCTTTACATCAGAAATTGTGTCGTTGACATCTTGAACTCTCCTATCTA
ATGCCGGTGTTCCACCTATAGATTTTGAATATTCGAATGCTGCATGAGTAGCATTAAATTCCTTAATATTGCCA
TAATTTTCATATATTGAGTAACCCTGGATAAAAAGTAAACACACCGCAGCCGTCGCTACCACAATAAAAAAA
ATTGATAGAGAGTTCATTTATAATCTATTAGAAGCTGACAAAATTTTTTTACACGCATCAGACAATGCTTTAA
TAAATAGTTCAACATCTACTTTTGTCATATCGAACCGATGGTATGATTCTAACCTAGAATTACATCCGAAAAA
GTTGACTATGTTCATAGTCATTAAGTCATTAACAAACAACATTCCAGACTCTGGATTATAAGACGATACTGTT
TCGTCACAATTACCTACCTTAATCATGTGATTATGAATATTGGCTATTAGAGCACCTTCTAAGAAATCTATAATA
TCTTTGAAACACGATTTAAAATCAAACCACGAATATACTTCTACGAAGAAAGTTAGTTTACCCATAGGAGAA
ATAACTATAAATGGAGATCTAAATACAAAATCCGGATCTATGATAGTTTTAACATTATTATATTCTCTATTAAAT
ACCTCCACATCTAAAAATGTTAATTTTGAAACTATGTCTTCGTTTATTACCGTACCTGAACTAAACGCTATAAG
CTCTATTGTTTGAGAACTCTTTAAACGATATTCTTGAAATACATGTAACAAAGTTTCCTTTAACTCGGTCGGT
TTATCTACCATAGTTACAGAATTTGTATCCTTATCTATAATATAATAATCAAAATCGTATAAAGTTATATAATTATC
GCGTTCAGATTGGGATCTTTTCAAATAGACTAAAAACCCCATTTCTCTAGTAAGTATCTTATGTATATGTTTGT
AAAATATCTTCATGGTGGGAATATGCTCTACCGCAGTTAGCCATTCCTCATTGACAGCGGTAGATGTATTAGA
CAAAACTATTCCAATGTTTAACAAGGGCCATTTTACGAGATTATTAAATCCTTGTTTGATAAATGTAGCCAAT
GAGGGTTCGAGTTCAACGACGATTGAATTCTCTTCCCGCGGATGCTGCATGATGAACGACGGGATGTTGTT
CGATTGATTTGGAATTCTTTTTCGACTTTTTGTTTATATTAAATATTTTAAAATTTATAGCGGATAGCAATTCAT
GTACCACGGATAATGTAGACGCGTATTGCGCATCGATATCTTTATTATTAGATAAATTTATCAATAAATGTGAG
AAGTTTGCCTCGTTAAGGTCTTCCATTTAAATATTATATAAACATTTGTGTTTGTATCTTATTCGTCTTTTATGG
AATAGTTTTTTACTAGTAAAGCTGCAATTACACACTTTGTCCGTAAAACATAAATATAAACACCAGCTTTTATC
AATCGTTCCAAAAAGTCGACGGCGGACATTTTTAACATGGCATCTATTTTAAATACACTTAGGTTTTTGGAA
AAAACATCATTTTATAATTGTAACGATTCAATAACTAAAGAAAGATTAAGATTAAACATAAGGGAATGTCAT
TTGTATTTTATAAGCCAAAGCATTCTACCGTTGTTAAATACTTGTCTGGAGGAGGTATATATCATGATGATTTG
GTTGTATTGGGGAAGGTAACAATTAATGATCTAAAGATGATGCTATTTTACATGGATTTATCATATCATGGAG
TGACAAGTAGTGGAGCAATTTACAAATTGGGATCGTCTATCGATAGACTTTCTCTAAATAGGACTATTGTTAC
AAAAGTTAATAATTATGATGATACATTTTTTGACGACGATGATTGATCGCTATTGCACAATTTTGTTTTTTTAC
TTTCTAATATAGCGTTTAGATTCTTTTTCATGTGCGAATATTGATTTACTAAAATATCGATGTTTAACTTTTGTT
CTATGACGTCCTTATCAGCGGTATCGGTACATATACGTAATTCACCTTCACAAAATACGGAGTCTTCGATAATA
ATAGCCAATCGATTATTGGATCTAGCGGTCTGTATCATATTCAACATGTTAATATATCCTTTCGTTTCCCCTTT
ACAGGCATCGATCGTAGCATATTTTCCGCGTCTGAGATGGAAATGTTAAAACTACAAAAATGCGTAATGTTA
GCCCGTCCTAATATTGGTACGTGTCTATAAGTTTGGCATAGTAGAATAATAGACGTGTTTAAATGCCTTCCAA
AGTTTAAGAATTCTATTAGAGTATTGCATTTTGATAGTTTATCGCCTACATCATCAAAAATAAGTAAAAAGTG
TGCTGATTTTTTATGATTTTGTGCGACAGCAATACATTTTTCTATGTTACTTTTAGTTCGTATCAGATTATATTC
TAGAGATTCCTGACTACTAACGAAATTAATATGATTTGGCCAAATGTATCCATCATAATCTGGATTATAAACGG
GTGTAAACAAGAATATATGTTTATATTTTTTAACTAGTGTAGAAAACAGAGATAGTAAATAGATAGTTTTTCC
AGATCCAGATCCTCCCGTTAAAACCATTCTAAACGGCATTTTTAATAAATTTTCTCTTGAAAATTGTTTTTCTT
GGAAACAATTCATAATTATATTTACAGTTACTAAATTAATTTGATAATAAATCAAAATATGGAAAACTAAGGTC
GTTAGTAGGGAGGAGAACAAAGAAGGCACATCGTGACATAAATAACATTTATTATCATGATGACACCAGAA
AACGACGAAGAGCAGACATCTGTGTTCTCCGCTACTGTTTACAGAGACAAAATTCAGGGAAAGAATAAAC
GCAAACGCGTGATTGGTCTATGTATTAGAATATCTATGGTTATTTCACTACTATCTATGATTACCATGTCCGCG
TTTCTCATAGTGCGCCTAAATCAATGCATGTCTGCTAACGAGGCTGCTATTACTGACGCCGCTGTTGCCGTT
GCTGCTGCATCATCTACTCATAGAAAGGTTGCGTCTAGCACTACGCAATATGATCACAAAGAAAGCTGTAAT
GGTTTATATTACCAGGGTTCTTGTTATATATTACATTCAGACTACCAGTTATTCTCGGATGCTAAAGCAAATTG
CACTGCGGAATCATCAACACTACCCAATAAATCCGATGTCTTGACTACCTGGCTCATTGATTATGTTAAGGAT

FIG. 11AS

```
ACATGGGGATCTGATGGTAATCCAATTACAAAAACTACATCCGATTATCAAGATTCTGATGTATCACAAGAA
GTTAGAAAGTATTTTTGTGTTAAAACAATGAACTAATATTTATTTTTGTACATTAATAAATGAAATCGCTTAAT
AGACAAACTGTAAGTAGGTTTAAGGAAGTTGTCGGTGCCGGCCGCTATAATGATGATACTCTCAACCATTATT
AGTGGCATAGGAACATTTCTGCATTACAAAGAAGAACTGATGCCTAGTGCTTGCGCCAATGGATGGATACA
ATACGATAAACATTGTTATTTAGATACTAACATTAAAATGTCTACAGATAATGCGGTTTATCAGTGTCGTAAAT
TACGAGCCAGATTGCCTAGACCGGATACTAGACATCTGAGAGTATTGTTTAGTATTTTTTATAAAGATTATTG
GGTAAGTTTAAAAAAGACCAATGATAAATGGTTAGATATTAATAATGATAAAGATATAGATATTAGTAAATTA
ACAAATTTTAAACAACTAAACAGTACGACGGATGCTGAAGCGTGTTATATATACAAGTCTGGAAAACTGGT
TAAAACAGTATGTAAAAGTACTCAATCTGTACTATGTGTTAAAAAATTCTACAAGTGACAACAAAAAATGAA
TTAATAATAAGTCGTTAACGTACGCCGCCATGGACGCCGCGTTTGTTATTACTCCAATGGGTGTGTTGACTAT
AACAGATACATTGTATGATGATCTCGATATCTCAATCATGGACTTTATAGGACCATACATTATAGGTAACATAA
AAACTGTCCAAATAGATGTACGGGATATAAAATATTCCGACATGCAAAAATGCTACTTTAGCTATAAGGGTA
AAATAGTTCCTCAGGATTCTAATGATTTGGCTAGATTCAACATTTATAGCATTTGTGCCGCATACAGATCAAA
AAATACCATCATCATAGCATGCGACTATGATATCATGTTAGATATAGAAGATAAACATCAGCCATTTTATCTATT
CCCATCTATTGATGTTTTTAACGCTACAATCATAGAAGCGTATAACCTGTATACAGCTGGAGATTATCATCTAA
TCATCAATCCTTCAGATAATCTGAAAATGAAATTGTCGTTTAATTCTTCATTCTGCATATCAGACGGCAATGG
ATGGATCATAATTGATGGGAAATGCAATAGTAATTTTTTATCATAAAAGTTGTAAAGTAAATAATAAAACAAT
AAATATTGAACTAGTAGTACGTATATTGAGCAATCAGAAATGATGCTGGTACCTCTTATCACGGTGACCGTAG
TTGCGGGAACAATATTAGTATGTTATATATTATATATTTGTAGGAAAAAGATACGTACTGTCTATAATGACAATA
AAATTATCATGACAAAATTAAAAAAGATAAAGAGTTCTAATTCCAGCAAATCTAGTAAATCAACTGATAGCG
AATCAGACTGGGAGGATCACTGTAGTGCTATGGAACAAAACAATGACGTAGATAATATTTCTAGGAATGAG
ATATTGGACGATGATAGCTTCGCTGGTAGTTTAATATGGGATAACGAATCCAATGTTATGGCGCCTAGCACA
GAACACATTTACGATAGTGTTGCTGGAAGCACGCTGCTAATAAATAATGATCGTAATGAACAGACTATTTATC
AGAACACTACAGTAGTACTTAATGAAGATACCAAACAGAATCCTAACTATTCATCCAATCCTTTCGTAAATTA
TAATAAAACCAGTATTTGTAGCAAGTCAAATCCGTTCATTACAGAACTCAACAATAAATTTAGTGAGAATAAT
CCGTTTAGACGAGCACATAGCGATGATTATCTTAATAAGCAAGAACAAGATCATGAACACGATGATATAGAA
TCATTGGTGTGATTAGTTTCCTTTTTATAAAATTGAAGTAATATTTAGTATTATTGCTGCCGTCACGTTGTACA
AATGGAGATATTCCCTGTATTCGGCATTTCTAAAATTAGCAATTTTATTGCTAATAATGACTGTAGATATTATAT
AGATACAGAACATCAAAAAATTATATCTGATGAGATCAATAGACAGATGGATGAAACGGTACTTCTTACCAA
CATCTTAAGCGTAGAAGTTGTAAATGACAATGAGATGTACCATCTTATTCCTCATAGATTATCGACGATTATAC
TCTGTATTAGTTCTGTCGGAGGATGTGTTATCTCTATAGATAATGACGTCAATGGCAAAAATATTCTAACCTTT
CCCATTGATCATGCTGTAATCATATCCCCACTGAGTAAATGTGTCGTAGTTAGCAAGGGTCCTACAACCATAT
TGGTTGTTAAAGCGGATATACCTAGCAAACGATTGGTAACATCGTTTACAAACGACATACTGTATGTAAACA
ATCTATCACTGATTAATTATTTGCCGTTGTCTGTATTCATTATTAGACGAGTTACCGACTATTTGGATAGACAC
ATATGCGATCAGATATTTGCGAATAATAAGTGGTATTCCATTATAACCATCGACAATAAGCAGTTTCCTATTCC
ATCAAACTGTATAGGTATGTCCTCTGCCAAGTACATAAATTCTAGCATCGAGCAAGATACTTTAATACATGTTT
GTAACCTCGAGCATCCATTCGACTTAGTATACAAAAAAATGCAGTCGTACAATTCTGTACCTATCAAGGAAC
AAATATTGTACGGTAGAATTGATAATATAAATATGAGCATTAGTATTTCTGTGGATTAATAGATTTCTAGTATG
GGGATCATTAATCATCTCTAATCTCTAAATACCTCATAAAACGAAAAAAAAGCTATTATCAAATACTGTACGG
AATGGATTCATTCTCTTCTCTTTTTATGAAACTCTGTTGTATATCTACTGATAAAACTGGAAGCAAAAAATCTG
ATAAAAAGAATAAGAATAAGATCAAGGATTATTATAAAATAACAATAGTTCCTGGTTCCTCTTCCACGTCTAC
TAGCTCGTGGTATTATACACATGCCTAGTAATAGTCTCTTTGCGTTGACGGAAAGCAGACTAGAAATAACAG
GCTAAAATGTTCAGACACCATAATAGTTCCCAACCCAGATAATAACAGAGTACCATCAACACATTCCTTTAAA
CTCAATCCCAAACCCAAAACCGTTAAAATGTATCCGGCCAATTGATAGTAGATAATGAGGTGTACAGCGCAT
```

FIG. 11AT

GATAATTTACACAGTAACCAAAATGAAAATACTTTAGTAATTATAAGAAATATAGATGGTAACGTCATCATCA
ACAATCCAATAATATGCCGGAGAGTAAACATTGACGGATAAAACAAAAATGCTCCGCATAACTCTATCATGG
CAATAACACAACCAAATACTTGTAAGATTCCTAAATTAGTAGAAAATACAACGGATATCGATGTATAAGTGAT
CTCGAGAAATAATAAGAATAAAGTAATGCCCGTAAAGATAAACATCAACATTGTTTGGTAATCATTAAACCA
ATTAGTATGAAGTTGAACTAATTTCACAGTAGATTTTATTCCAGTATTATCCCCGCATGTATAAGTACCTGGTA
AGATATCTTTATATTCCATAATCAATGAGACATCACTATCTGATAACGAATGAAGTCTAGCACTAGTATGCCAT
TTACTTAATATTGTCGTCTTGGAAGTTTTATTATAAGTTAAAATATCATGGTTATCCAATTTCCATCTAATATACT
TTGTCGGATTATCTATAGTACACGGAATAATGATGGTATCATTACATGCTGTATACTCTATGGTCTTTGTAGTTG
TTATAACAACCAACGTATAGAGGTATATCAACGATATTCTAACTCTTGACATTTTTTATTTATTTAAAATGATAC
CTTTGTTATTTATTTTATTCTATTTTGCTAACGGTATTGAATGGCATAAGTTTGAAACGAGTGAAGAAATAATT
TCTACTTACTTATTAGACGACGTATTATACACGGGTGTTAATGGGGCGGTATACACATTTTCAAATAATAAAC
TAAACAAAACTGGTTTAACTAATAATAATTATATAACAACATCTATAAAAGTAGAGGATGCGGAACCAATAAC
GGAAATCCCAAATGTTGGAAAATAGACGGTTCAGACGACCCAAAACATAGAGGTAGAGGATACGCTCCTT
ATCAAAATAGCAAAGTAACGATAATCAGTCACAACGGATGTGTACTATCTGACATAAACATATCAAAAGAAG
GAATTAAACGATGGAGAAGATTTGACGGACCATGTGGTTATGATTTATACACGGCGGATAACGTAATTCCA
AAAGATGGTTTACGAGGAGCATTCGTCGATAAAGATGGTACTTATGACAAAGTTTACATTCTTTTCACTGAT
ACTATCGGCTCAAAGAGAATTGTCAAAATTCCGTATATAGCACAAATGTGCCTAAACGACGAAGGTGGTCC
ATCATCATTGTCTAGTCATAGATGGTCGACGTTTCTCAAAGTCGAATTAGAATGTGATATCGACGGAAGAAG
TTATAGACAAATTATTCATTCTAGAACTATAAAAACAGATAATGATACGATACTATATGTATTCTTCGATAGTCC
TTATTCCAAGTCCGCATTATGTACCTATTCTATGAATACCATTAAACAATCTTTTTCTACGTCAAAATTGGAAG
GATATACAAAGCAATTGCCGTCTCCAGCTCCTGGTATATGTTTACCAGCTGGAAAAGTTGTTCCACATACCA
CGTTTGAAGTCATAGAAAAATATAATGTACTAGATGATATTATAAAGCCTTTATCTAACCAACCTATCTTCGAA
GGACCGTCTGGTGTTAAATGGTTCGATATAAAGGAGAAGGAAAATGAACATCGGGAATATAGAATATACTT
CATAAAAGAAAATTCTATATATTCGTTCGATACAAAATCTAAACAAACTCGTAGCTCGCAAGTCGATGCGCG
ACTATTTTCAGTAATGGTAACTTCGAAACCGTTATTTATAGCAGATATAGGGATAGGAGTAGGAATGCCACA
AATGAAAAAAATACTTAAAATGTAATCTTAATCGAGTACACCGCACGACAATGAACAAACATAAGACAGATT
ATGCTGGTTATGCTTGCTGCGTAATATGCGGTCTAATTGTTGGAATTATTTTTACAGCGACACTATTAAAAGT
TGTAGAACGTAAATTAGTTCATACACCATCAATAGATAAAACGATAAAAGATGCATATATTAGAGAAGATTGT
CCTACTGACTGGATAAGCTATAATAATAAATGTATCCATTTATCTACTGATCGAAAAAACCTGGGAGGAAGG
ACGTAATGCATGCAAAGCTCTAAATCCAAATTCGGATCTAATTAAGATAGAGACTCCAAACGAGTTAAGTTT
TTTAAGAAGCCTTAGACGAGGCTATTGGGTAGGAGAATCCGAAATATTAAACCAGACAACCCCATATAATTT
TATAGCTAAAAATGCCACGAAGAATGGAACTAAAAAACGGAAATATATTTGTAGTACAACGAATACTCCCAA
ACTGCATTCGTGTTACACTATATAACAATTACACTACATTTTTATCATAACACTACTTCGGTTAGATGTTTTAGA
AAAAAATAAATATCGCCGTACCGTTCTTGTTTTTATAAAAATAACAATTAACAATTATCAAATTTTTTCTTTAAT
ATTTTACGTGGTTGACCATTCTTGGTGGTAAAATAATCTCTTAGTGTTGGAATGGAATGCTGTTTAATGTTTC
CGCACTCATCGTATATTTTGACGTATGCAGTCACATCGTTTACGCAATAGTCAGACTGTAGTTCTATCATGCTT
CCTACATCAGAAGGAGGAACAGTTTTAAAGTCTCTTGGTTTTAATCTATTGCCATTAGTTTTCATGAAATCCT
TTGTTTTATCCACTTCACATTTTAAATAAATGTCCACTATACATTCTTCTGTTAATTTTACTAGATCGTCATGGG
TCATAGAATTTATAGGTTCCGTAGTCCATGGATCCAAACTAGCAAACTTCGCGTATACGGTATCGCGATTAGT
GTATACACCAACTGTATGAAAATTAAGAAAACAGTTTAATAAATCAACAGAAATATTTAATCCTCCGTTTGAT
ACAGATGCGCCATATTTATGGATTTCGGATTCACACGTTGTTTGTCTGAGGTGTTCGTCTAGTGTTGCTTCTA
CGTAAACTTCGATTCCCATATATTCTTTATTGTCAGAATCGCATACCGATTTATCATCATACACTGTTTGAAAAC
TAAATGGTATACACATCAAAATAATAAATAATAACGAGTACATTCTGCAATATTGTTATCGTAATTGGAAAATT
AGTGTTCGAGTGAGTCGGATTATGTGAGTACTGGATTGTATATTTTATTTTATATTTTGTAATAAGAATAAAAT

FIG. 11AU

GCTAATGTCAAGTTTATTCCAATAGATGTCTTATTAAAAAAACATATATAATAAATAACAATGGCTGAATGGCAT
AAAATTATCGAGGATATCTCAAAAAATAATAAGTTCGAGGATGCCGCCATCGTTGATTACAAGACTACAAAG
AATGTTCTAGCTGCTATTCCTAACAGAACATTTGCCAAGATTAATCCGGGTGAAATTATTCCTCTCATCACTA
ATCGTAATATTCTAAAACCTCTTATTGGTCAGAAATATTGTATTGTATATACTAACTCTCTAATGGATGAGAACA
CGTATGCTATGGAGTTGCTTACTGGGTACGCCCCTGTATCTCCGATCGTTATAGCGAGAACTCATACCGCACT
TATATTTTTGATGGGTAAGCCAACAACATCCAGACGTGATGTGTATAGAACGTGTAGAGATCACGCTACCCG
TGTACGCGCAACTGGTAATTAAAATAAAAAGTAATATTCATATGTAGTGTCAATTTTAAATGATGATGATGAA
ATGGATAATATCCATATTGACGATGTCAATAATGCCGGTATTGGCATACAGCTCATCGATTTTTAGATTTCATT
CAGAGGATGTGGAATTATGTTATGGGCATTTGTATTTTGATAGGATCTATAATGTAGTAAATATAAAATATAAT
CCGCATATTCCATATAGATATAATTTTATTAATCGCACGTTAACCGTAGATGAACTAGACGATAATGTCTTTTTT
ACACATGGTTATTTTTTAAAACACAAATATGGTTCACTTAATCCTAGTTTGATTGTCTCATTATCAGGAAACTT
AAAATATAATGATATACAATGCTCAGTAAATGTATCGTGTCTCATTAAAAATTTGGCAACGAGTACATCTACTA
TATTAACATCTAAACATAAGACTTATTCTCTACATCGGTCCACGTGTATTACTATAATAGGATACGATTCTATTA
TATGGTATAAAGATATAAATGACAAGTATAATGACATCTATGATTTTACTGCAATATGTATGCTAATAGCGTCTA
CATTGATAGTGACCATATACGTGTTTAAAAAAATAAAAATGAACTCTTAATTATGCTATGCTATTAGAAATGG
ATAAAATCAAAATTACGGTTGATTCAAAAATTGGTAATGTTGTTACCATATCGTATAACTTGGAAAAGATAAC
TATTGATGTTACACCTAAAAAGAAAAAAGAAAAGGATGTATTATTAGCGCAATCAGTTGCTGTCGAAGAGG
CAAAAGATGTCAAGGTAGAAGAAAAAAATATTATCGATATTGAAGATGACGATGATATGGATGTAGAAAGC
GCATAATACGATCTATAAAAATAAGTATATAATAAATACTTTTTATTTACGGTACTCTTGTAGTGGTGATACCCT
ACTCAATTATTTTTTTAAAAAAATACTTATTCTGATTCTTCTAGCCATTTCCGTGTTCGTTCGAATGCCACATC
GACGTTAAAGATAGGGGAGTAGTTGAAATCTAGTTCTGCATTGTTGGTACGCACCTCAAATGTAGTGTTGG
ATATCTTCAACGTATAGTTGTTGAGTAGTGATGGTTTTCTAAATAGAATTCTCTTCATATCATTCTTGCACGCG
TACATTTTTAGCATCCATCTTGGAATTCTAGATCCTTGTTCTATTCCCAATGGTTTCATCAATAGAAGATTAAA
CATATCGTACGAACACGATGGAGAGTAATCGTAGCAAAAGTAAGCATTTCCTTTAATCTTAGATCCCGGATA
CTGGATATATTTTGCAGCCAACACGTGCATCCATGCAGCATTTCCTACATATACCCGGCTATGCACCGCGTCA
TCATCGACTGTACGATACATAATGTTACCGTGTTGCTTACATTGCTCGTAAAAGACTTTCGTCAATTTGTCTCC
TTCTCCGTAAATTCCAGTGGGTCTTAGGCAACAAGTATACAATTTTGCTCCATTCATGATTACGGAATTATTG
GCTTTCATAACCAGTTGCTCGGCCATACGTTTACTTTTTGCGTATACATGTCCTGGTGATATATCATAAAGGG
TATGCTCATGGCCGATGAATGGATCACCGTGTTTATTGGGTCCTATTGCTTCCATGCTACTAGTATAGATCAA
ATACTTGATTCCTAGGTCCACACAAGCTGCCAATATAGTCTGTGTTCCATAATAGTTTACTTTCATGATTTCAT
TATCGGTGTATTTTCCAAATACATCCACTAGAGCAGCCGTATGAATAATCAGATTTACCCCATCTAGCGCTTCT
CTCACCTTATCAAAGTCGTTTATATCACATTGTATATAGTTTATAACCTTAACTTTCGAGGTTATTGGTTGTGG
ATCTTCTACAATATCTATGACTCTGATTTCTTGAACATCATCTGCACTAATTAACAGTTTTACTATATACCTGCC
TAGAAATCCGGCACCACCAGTAACCGCGTACACGGCCATTGCTGCCACTCATAATATCAGACTACTTATTCTA
TTTTACTAAATAATGGCTGTTTGTATAATAGACCACGATAATATCAGAGGAGTTATTTACTTTGAACCAGTCC
ATGGAAAAGATAAAGTTTTAGGATCAGTTATTGGATTAAAATCCGGAACGTATAGTTTGATAATTCATCGTTA
CGGAGATATTAGTCAAGGATGTGATTCCATAGGCAGTCCAGAAATATTTATCGGTAACATCTTTGTAAACAG
ATATGGTGTAGCATATGTTTATTTAGATACAGATGTAAATATATTTACAATTATTGGAAAGGCGTTATCTATTTC
AAAAAATGATCAGAGATTAGCGTGTGGAGTTATTGGTATTTCTTACATAAATGAAAAGATAATACATTTTCTT
ACAATTAACGAGAATGGCGTTTGATATATCAGTTAATGCGTCTAAAACAATAAATGCATTAGTTTACTTTTCT
ACTCAGCAAAATAAATTAGTCATACGTAATGAAGTTAATGATACACACTACACTGTCGAATTTGATAGGGAC
AAAGTAGTTGACACGTTTATTTCATATAATAGACATAATGACACCATAGAGATAAGAGGGGGTGCTTCCAGAG
GAAACTAATATTGGTTGCGCGGTTAATACGCCGGTTAGTATGACTTACTTGTATAATAAGTATAGTTTTAAAC
TGATTTTAGCAGAATATATAAGACACAGAAATACTATATCCGGCAATATTTATTCGGCATTGATGACACTAGAT

FIG. 11AV

GATTTGGCTATTAAACAGTATGGAGACATTGATCTATTATTTAATGAGAAACTTAAAGTAGACTCCGATTCGG
GACTATTTGACTTTGTCAACTTTGTAAAGGATATGATATGTTGTGATTCTAGAATAGTAGTAGCTCTATCTAGT
CTAGTATCTAAACATTGGGAATTGACAAATAAAAAGTATAGGTGTATGGCATTAGCCGAACATATATCTGATA
GTATTCCAATATCTGAGCTATCTAGACTACGATACAATCTATGTAAGTATCTACGCGGACACACTGAGAGCAT
AGAGGATGAATTTGATTATTTTGAAGACGATGATTCGTCTACATGTTCTGCCGTAACCGACAGGGAAACGG
ATGTATAATTTTTTTTATAGCGTGAAGGATATGATAAAAAATATAATTGTTGTATTTATCCCATTCCAATCACCT
TATATGATTCTGTAAAAAAATTATACTGTAACACAATAAAGGAGTCTTATAGATGTATAGAGGTCAGATACTG
GTTTGATAAACTGTTTATTCCACATAAGTATGTTTGACTTTATGGTTAGACCCGCATACTTTAACAAATCACTG
AAAATTGGAGTTAGGTATTGACCTCTCAGAATCAGTTGCCGTTCTGGAACATTAAATGTATTTTTTATGATAT
ACTCCAACGCATTTATGTGGGCATACAACAAGTCATTACTAATGGAGTATTCCAAGAGTTTTAGTTGTCTAGT
ATTTAACAAGAGAAGAGATTTCAACAGACTGTTTATGAACTCGAACGCCGCCTCATTGTCGCTTATATTGAT
GATGTCGAATTCTCCCAATATCATCACTGATGAGTAGCTCATCTTGTTATCGGGATCCAAGTTTTCTAAAGAT
GTCATTAAACCCTCGATCATGAATGGATTTATCATCATCGTTTTTATGTTGGACATGAGCTTAGTCCGTTTGTC
CACATCTATAGACGACGATTTCTGAATTATTTCATATATCCCTCTCTTTAACTCCAGGAACTTGTCAGGATGGT
CTACTTTAATATGTTCTCGTCTAAGAGATGAAAATCTTTGGATGGTTGCACGCGACTTTTCTTTAAAGGATG
ACGTTGCCCAAGATCCTCTCTTAAATGAATCCATCTTATCCTTGGACAAGATGGACAGTCTATTTTCCTTAGA
TGGTTTAATATTTTTGTTACCCATGATCTATAAAGGTAGACCTAATCGTCTCGGATGACCATATATTTATTTTCA
GTTTTATTATACGCATAAATTGTAAAAAATATGTTAGGTTTACAAAAATGTCTCGTGGGGCATTAATCGTTTTT
GAAGGATTGGACAAATCTGGAAAAACAACACAATGTATGAACATCATGGAATCTATACCGGCAAACACGAT
AAAATATCTTAACTTTCCTCAGAGATCCACTGTCACTGGAAAGATGATAGATGACTATCTAACTCGTAAAAA
AACCTATAATGATCATATAGTTAATCTATTATTTTGTGCAAATAGATGGGAGTTTGCATCTTTTATACAAGAAC
AACTAGAACAGGGAATTACTTTAATAGTTGATAGATACGCATTTTCTGGAGTAGCGTATGCCGCCGCTAAAG
GCGCGTCAATGACTCTCAGTAAGAGTTATGAATCTGGATTGCCTAAACCCGACTTAGTTATATTCTTGGAATC
TGGTAGCAAAGAAATTAATAGAAACGTCGGCGAGGAAATTTATGAAGATGTTACATTCCAACAAAAGGTAT
TACAAGAATATAAAAAAATGATTGAAGAAGGAGATATTCATTGGCAAATTATTTCTTCTGAATTCGAGGAAG
ATGTAAAGAAGGAGTTGATTAAGAATATAGTTATAGAGGCTATACACACGGTTACTGGACCAGTGGGGCAA
CTGTGGATGTAATAGTGAAATTACATTTTTTATAAATAGATGTTAGTACAGTGTTATAAATGGATGAAGCATAT
TACTCTGGCAACTTGGAATCAGTACTCGGATACGTGTCCGATATGCATACCGAACTCGCATCAATATCTCAAT
TAGTTATTGCCAAGATAGAAACTATAGATAATGATATATTAAACAAGGACATTGTAAATTTTATCATGTGTAGA
TCAAACTTGGATAATCCATTTATCTCTTTCCTAGATACTGTATATACTATTATAGATCAAGAGATCTATCAGACC
GAATTGATTAATTCATTAGACGACAATGAAATTATCGATTGTATAGTTAACAAGTTTATGAGCTTTTATAAGG
ATAACCTAGAAAATATAGTAGATGCTATCATTACTCTAAAATATATAATGAATAATCCAGATTTTAAAACTACGT
ATGCCGAAGTACTCGGTTCCAGAATAGCCGATATAGATATTAAACAAGTGATACGTAAGAATATACTACAATT
GTCTAATGATATCCGCGAACGATATTTGTGAAAAATATTAAAAAAAAATACTTTTTTTATTAAATGACGTCGC
TTCGCGAATTTAGAAAATTATGCTGTGATATATATCACGCATCAGGATATAAAGAAAAATCTAAATTAATTAGA
GACTTTATAACAGATAGGGATGATAAATATTTGATCATTAAGCTATTGCTTCCCGGATTAGACGATAGAATTT
ATAACATGAACGATAAACAAATTATAAAATTATATAGTATAATATTTAAACAATCTCAGGAAGATATGCTACAA
GATTTAGGATACGGATATATAGGAGACACTATTAGGACTTTCTTCAAAGAGAACACAGAAATCCGTCCACG
AGATAAAAGCATTTTAACTTTAGAAGAAGTGGATAGTTTTTTAACTACGTTATCATCCGTAACTAAAGAATC
GCATCAAATAAAATTATTGACTGATGTAGCATCTGTTTGTACATGTAATGATTTAAAATGTGTAGTCATGCTTA
TTGATAAAGATCTAAAAATTAAAGCGGGCCCTCGGTACGTACTTAACGCTATTAGTCCTCATGCCTATGATGT
GTTTAGAAAATCTAATAACTTGAAAGAGATAATAGAAAATGCATCTAAACAAAATCTAGACTCTATATCTATT
TCTGTTATGACTCCAATTAATCCCATGTTAGCGGAATCGTGTGATTCTGTCAATAAGGCGTTTAAAAAATTTC
CATCAGGAATGTTTGCGGAAGTCAAATACGATGGTGAAAGAGTACAAGTTCATAAAAATAATAACGAGTTT

FIG. 11AW

GCCTTCTTTAGTAGAAACATGAAACCAGTACTCTCTCATAAAGTGGATTATCTCAAAGAATACATACCGAAA
GCATTTAAAAAAGCTACGTCTATCGTATTGGATTCTGAAATTGTTCTTGTAGACGAACATAATGTACCGCTAC
CGTTTGGAAGTTTAGGAATACACAAAAAGAAAGAATATAAAAACTCTAACATGTGTTTGTTCGTGTTTGAC
TGTTTGTACTTTGATGGATTCGATATGACGGACATTCCATTGTACGAACGAAGATCTTTTCTCAAAGATGTTA
TGGTTGAAATACCCAATAGAATAGTATTCTCAGAGTTGACGAATATTAGTAACGAGTCTCAGTTAACTGACG
TATTGGATGATGCACTAACGAGAAAATTAGAAGGATTGGTCTTAAAAGATATTAATGGAGTATACGAACCG
GGAAAGAGAAGATGGTTAAAAATAAAGCGAGACTATTTGAACGAGGGTTCCATGGCAGATTCTGCCGATT
TAGTAGTACTAGGTGCCTACTATGGTAAAGGAGCAAAGGGTGGTATCATGGCAGTCTTTCTAATGGGTTGT
TACGACGATGAATCCGGTAAATGGAAGACGGTTACCAAGTGTTCAGGACACGATGATAATACGTTAAGGG
AGTTGCAAGACCAATTAAAGATGATTAAAATTAACAAGGATCCCAAAAAAATTCCAGAGTGGTTAGTAGTT
AATAAAATCTATATTCCCGATTTTGTAGTAGAGGATCCGAAACAATCTCAGATATGGGAAATTTCAGGAGCA
GAGTTTACATCTTCCAAGTCCCATACCGCAAATGGAATATCCATTAGATTTCCTAGATTTACTAGGATAAGAG
AGGATAAAACGTGGAAAGAATCTACTCATCTAAACGATTTAGTAAACTTGACTAAATCTTAATAGTTACATAC
AAACTGAAAATTAAAATAACACCATTTAGTTGGTGGTCGCCATGGATGGTGTTATTGTATACTGTCTAAACG
CGTTAGTAAAACATGGCGAGGAAATAAATCATATAAAAAATGATTTCATGATTAAACCATGTTGTGAAAGAG
TTTGTGAAAAAGTCAAGAACGTTCACATTGGCGGACAATCTAAAAACAATACAGTGATTGCAGATTTGCCA
TATATGGATAATGCGGTATCCGATGTATGCAATTCACTGTATAAAAAGAATGTATCAAGAATATCCAGATTTGC
TAATTTGATAAAGATAGATGACGATGACAAGACTCCTACTGGTGTATATAATTATTTTAAACCTAAAGATGTTA
TTCCTGTTATCATATCTATAGGAAAGGATAAAGATGTCTGTGAACTATTAATCTCATCAGACATATCGTGTGCA
TGCGTGGAGTTAAATTCATATCACGTAGCCATTCTTCCCATGAATGTTTCCTTTTTTACCAAAGGAAATGCCT
CGTTGATTATTCTCCTGTTTGATTTCTCTATCGATGCAGCACCTCTCTTAAGAAGTGTAACCGATAATAATGTT
ATTATATCTAGACACCAGCGTCTACATGACGAGCTTCCGAGTTCCAATTGGTTCAAGTTTTACATAAGTATAA
AGTCCGACTATTGTTCTATATTATATATGGTTGTTGATGGATCTGTGATGCATGCGATAGCTGATAATAGAACT
CACGCAATTATTAGCAAAAATATATTAGACAATACTACAATTAACGATGAGTGTAGATGCTGTTATTTTGAAC
CACAGATTAGGATTCTTGATAGAGATGAGATGCTCAATGGATCATCGTGTGATATGAACAGACATTGTATTAT
GATGAATTTACCTGATGTAGGCGAATTTGGATCTAGTATGTTGGGGAAATATGAACCTGACATGATTAAGAT
TGCTCTTTCGGTGGCTGGTAATTTAATAAGAAATCGAGACTACATTCCCGGGAGACGAGGCTATAGCTACTA
CGTTTACGGTATAGCCTCTAGATAATTTTTTTAAGCACGAAATAAAAAACATAATTTTAAACCAATCTATTTCA
TACTATTTTGTGTGATCACCATGGACATAAAGATAGATATTAGTATTTCTGGTGATAAATTTACGGTGACTACT
AGGAGGGAAAATGAAGAAAGAAAAAAATATCTACCTCTCCAAAAAGAAAAAACTACTGATGTTATCAAAC
CTGATTATCTTGAGTACGATGACTTGTTAGATAGAGATGAGATGTTTACTATTCTAGAGGAATATTTTATGTAC
AGAGGTCTATTAGGCCTCAGAATAAAATATGGACGACTCTTTAACGAAATTAAAAAATTCGACAATGATGCG
GAAGAACAATTCGGTACTATAGAAGAACTCAAGCAGAAACTTAGATTAAATTCTGAAGAGGGAGCAGATA
ACTTTATAGATTATATAAAGGTACAAAAACAGGATATCGTCAAACTTACTGTATACGATTGCATATCTATGATA
GGATTGTGTGCATGCGTGGTAGATGTTTGGAGAAATGAGAAACTGTTTTCTAGATGGAAATATTGTTTACG
AGCGATTAAACTGTTTATTAATGATCACATGCTTGATAAGATAAAATCTATACTGCAGAATAGACTAGTATATG
TGGAAATGTCATAGAAAGTTAATGAGAGCAAAATATATAAGGTTGTATTCCATATTTGTTATTTTTTCTGTAA
TAGTTAAAAAAATACATTCGATGGTCTATCTATCAGATTATTATGTGTTATAAGGTACTTTTTCTCATAATAAAC
TAGAGTATGAGTAAGATAGTGTTTTTCAAAACATATAAATCTAAAATTGATGGATGAGATATACAGCTATTAA
TTTCGAAAATATATAAATCTAAAATTGATGGATAAGATATACAGCTATTAATTTCGAAAATATATTTTAATCTGA
TAACTTTAAACATGGATTTTTGATGGTGGTTTAACGTTTTAAAAAAAGATTTTGTTATTGTAGTATATGATAAT
ATTAAAAGATGGATATAAAGAATTTGCTGACTGCATGTACTATTTTTTACATTACTACATTGGCTACGGCAGA
TATACCTACTCCGCCACCAACGGGTCATGTGACAAGGGAGAATATCTTGATAAGAGGCATAATCAATGTTGT
AATCGGTGTCCACCTGGAGAATTTGCCAAGGTTAGATGTAATGGTAACGATAACACAAAATGTGAACGCTG

FIG. 11AX

CCCACCTCATACATATACCACAATCCCCAATTATTCTAATGGATGTCATCAATGTAGAAAATGCCCAACCGGAT
CATTTGATAAGGTAAAGTGTACCGGAACACAGAACAGTAAATGTTCGTGTCTTCCTGGTTGGTATTGCGCTA
CTGATTCTTCACAGACTGAAGATTGTTGAAATTGTGTACCAAAAAGGAGATGTCCATGCGGATACTTTGGT
GGAATAGATGAACAAGGAAATCCTATTTGTAAATCGTGCTGTATTGGTGAATATTGCAACTACCTACGTAATT
ATAGACTTGATCCATTTTCTCCATGCAAACTATCTAAATGTAATTAATTATGATTTTGATGATAATGTTACCATA
CATTATATCGCTACTTGGTTAGTGTATTATTCAGTATGAAGACCTATTAATAATTACTTATCTTTTGACGATCTT
GTTATAATTATAATATAAAAACTTATGGCATAGTAACTCATAATTGCTGACGCGATAAATTCGTAATAATCTGTT
TTGTTCAAATTTTTATAAGGAATCTACAGGCATAAAAATAAAAATATAATTTATAATATACTCTTACAGCGCGC
CATCATGAATAGCAGCAGTAAATTAATTGCTGTTATTAATGGATTTAGAAATAGTGGACGATTTTGTGATATT
AATATAGTTATTAATGATGAAAGGATAAACGCTCACAGACTCATCCTATCTGGAGCCTCCGAATATTTTTCCA
TTCTGTTTTCCAATAATTTTATCGATTCTAATGAATACGAAGTTAATCTAAGTCATTTAGATTATCAAAGTGTTA
ACGATTTGATCGATTACATTTATGGGATACCTTTGAGCCTAACTAACGATAACGTGAAATATATTCTTTCAACC
GCTGATTTTTTACAAATTGGATCTGCCATTACTGAGTGCGAAAAATACATACTTAAAAATCTTTGTTCTAGAA
ACTGTATCGATTTCTACATATACGCTGATAAATATAATAACAAGAAAATAGAATCAGCGTCGTTTAACACAATA
TTACGAAATATTTTGAGACTCATCAACGATGAAAACTTTAAATACTTAACAGAGGAATCAATGATAAAAATT
TTAAGCGATGATATGTTAAATATAAAAAATGAGGATTTTGCACCACTAATTCTCATTAAATGGTTAGAGAGTA
CTCAACAATCATGCACCGTCGAGTTACTTAGATGCCTCAGAATATCATTGCTTTCCCCACAAGTTATAAAATC
ACTTTATAGTCATCAACTGGTTAGTTCAATCTACGAATGTATAACATTCTTAAACAATATAGCATTCTTGGATG
AATCATTTCCTAGATACCATAGCATCGAGTTGATATCTATCGGTATAAGTAATTCGCATGATAAGATTTCCATA
AACTGCTACAATCATAAAAAAAATACATGGGAAATGATATCTTCACGTAGATATAGGTGTAGTTTCGCAGTG
GCCGTCCTGGATAATATTATCTATATGATGGGTGGATATGATCAGTCCCCGTATAGAAGTTCAAAGGTTATAG
CGTACAATACATGTACAAATTCTTGGATATATGATATACCAGAGCTAAAATATCCTCGTTCTAATTGTGGGGG
ACTGGCTGATGACGAATACATTTATTGTATAGGCGGCATACGCGATCAGGATTCATCGTTGACATCTAGTATT
GATAGATGGAAGCCATCAAAACCATATTGGCAGAAGTATGCTAAAATGCGCGAACCAAAATGTGATATGGG
GGTTGCGATGTTAAACGGATTAATATATGTCATGGGTGGAATCGTTAAAGGTGACACGTGTACCGACGCAC
TAGAGAGTTTATCAGAAGATGGATGGATGAAGCATCAACGTCTTCCAATAAAAATGTCCAATATGTCGACG
ATTGTTCATGATGGCAAGATTTATATATCTGGAGGTTACAACAATAGTAGTGTAGTTAATGTAATATCGAATCT
AGTCCTTAGCTATAATCCGATATATGATGAATGGACCAAATTATCATCATTAAACATTCCTAGAATTAATCCCG
CTCTATGGTCAGCGCATAATAAATTATATGTAGGAGGAGGAATATCTGATGATGTTCGAACTAATACATCTGA
AACATACGATAAAGAAAAGATTGTTGGACATTGGATAATGGTCACGTGTTACCACGCAATTATATAATGTAT
AAATGCGAACCGATTAAACATAAATATCCATTGGAAAAAACACAGTACACGAATGATTTTCTAAAGTATTTG
GAAAGTTTTATAGGTAGTTGATAGAACAAAATACATAATTTTGTAAAAATAAATCACTTTTTATACTAATATGA
CACGATTACCAATACTTTTGTTACTAATATCATTAGTATACGCTACACCTTTTCCTCAGACATCTAAAAAAATA
GGTGATGATGCAACTCTATCATGTAATCGAAATAATACAAATGACTACGTTGTTATGAGTGCTTGGTATAAGG
AGCCCAATTCCATTATTCTTTTAGCTGCTAAAAGCGACGTCTTGTATTTTGATAATTATACCAAGGATAAAATA
TCTTACGACTCTCCATACGATGATCTAGTTACAACTATCACAATTAAATCATTGACTGCTAGAGATGCCGGTA
CTTATGTATGTGCATTCTTTATGACATCAACTACAAATGACACTGATAAAGTAGATTATGAAGAATACTCCACA
GAGTTGATTGTAAATACAGATAGTGAATCGACTATAGACATAATACTATCTGGATCTACACATTCACCAGAAA
CTAGTTCTGAGAAACCAGAGGATATAGATAATTTTAATTGCTCGTCGGTATTCGAAATCGCGACTCCGGAAC
CAATTACTGATAATGTAGAAGATCATACAGACACCGTCACATACACTAGTGATAGCATTAATACAGTAAGTGC
ATCATCTGGAGAATCCACAACAGACGAGACTCCGGAACCAATTACTGATAAAGAAGAAGATCATACAGTCA
CAGACACTGTCTCATACACTACAGTAAGTACATCATCTGGAATTGTCACTACTAAATCAACCACCGATGATGC
GGATCTTTATGATACGTACAATGATAATGATACAGTACCACCAACTACTGTAGGCGGTAGTACAACCTCTATT
AGCAATTATAAAACCAAGGACTTTGTAGAAATATTTGGTATTACCGCATTAATTATATTGTCGGCCGTGGCAA

FIG. 11AY

TATTCTGTATTACATATTATATATATAATAAACGTTCACGTAAATACAAAACAGAGAACAAAGTCTAGATTTTT
GACTTACATAAATGTCTGGGATAGTAAAATCTATCATATTGAGCGGACCATCTGGTTCAGGAAAGACAGCCA
TAGCCAAAAGACTATGGGAATATATTTGGATTTGTGGTGTCCCATACCACTAGATTTCCTCGTCCTATGGAAC
GAGAAGGTGTCGATTACCATTACGTTAACAGAGAGGCCATCTGGAAGGGAATAGCCGCCGGAAACTTTCT
AGAACATACTGAGTTTTTAGGAAATATTTACGGAACTTCTAAAACTGCTGTGAATACAGCGGCTATTAATAA
TCGTATTTGTGTGATGGATCTAAACATCGATGGCGTTAGAAGTCTTAAAAATACGTACCTAATGCCTTACTCG
GTGTATATAAGACCTACCTCTCTTAAAATGGTTGAGACCAAGCTTCGTTGTAGAAACACTGAAGCGGATGAT
GAGATTCATCGTCGTGTGATGTTGGCAAAAACTGACATGGATGAGGCAGGTGAAGCCGGTCTATTCGACA
CTATTATCATTGAAGATGATGTGAATTTAGCATATAGTAAGTTAATTCAGATACTACAGGACCGTATTAGAATG
TATTTTAACACTAATTAGAGACTTAAGACTTAAAACTTGATAATTAATAATATAACTCGTTTTTATATGTGGCTA
TTTCAACGTCTAATGTATTAGTTAAATATTAAAACTTACCACGTAAAACTTAAAATTTAAAATGATATTTCATT
GACAGATAGATCACACATTATGAACTTTCAAGGACTTGTGTTAACTGACAATTGCAAAAATCAATGGGTCGT
TGGACCATTAATAGGAAAAGGTGGATTCGGTAGTATTTATACTACTAATGACAATAATTATGTAGTAAAAATA
GAGCCCAAAGCTAACGGATCATTATTTACCGAACAGGCATTTTATACTAGAGTACTTAAACCATCCGTTATCG
AAGAATGGAAAAAATCTCACAATATAAAGCACGTAGGTCTTATCACGTGCAAGGCATTTGGTCTATACAAAT
CCATTAATGTGGAATATCGATTCTTGGTAATTAATAGATTAGGTGCAGATCTAGATGCGGTGATCAGAGCCA
ATAATAATAGATTACCAAAAAGGTCGGTGATGTTGATCGGAATCGAAATCTTAAATACCATACAATTTATGCA
CGAGCAAGGATATTCTCACGGAGATATTAAAGCGAGTAATATAGTCTTGGATCAAATAGATAAGAATAAATT
ATATCTAGTGGATTACGGATTGGTTTCTAAATTCATGTCTAATGGCGAACATGTTCCATTTATAAGAAATCCA
AATAAAATGGATAACGGTACTCTAGAATTTACACCTATAGATTCGCATAAAGGATACGTTGTATCTAGACGTG
GAGATCTAGAAACACTTGGATATTGTATGATTAGATGGTTGGGAGGTATCTTGCCATGGACTAAGATATCTG
AAACAAAGAATTGTGCATTAGTAAGTGCCACAAAACAGAAATATGTTAACAATACTGCGACTTTGTTAATGA
CCAGTTTGCAATATGCACCTAGAGAATTGCTGCAATATATTACCATGGTAAACTCTTTGACATATTTTGAGGA
ACCCAATTACGACGAGTTTCGGCACATATTAATGCAGGGTGTATATTATTAAGTGTGGTGTTTGGTCGATGTA
AAATTTTTGTCGATAAAAATTAAAAAATAACTTAATTTATTATTGATCTCGTGTGTACAACCGAAATCATGGC
GATGTTTACGCACACGCTCTCGGTGGGTACGACGAGAATCTTCATGCCTTTCCTGGAATATCATCGACTGT
TGCCAATGATGTCAGGAAATATTCTGTTGTGTCAGTTTATAATAACAAGTATGACATTGTAAAAGACAAATAT
ATGTGGTGTTACAGTCAGGTGAACAAGAGATATATTGGAGCACTGCTGCCTATGTTTGAGTGCAATGAATAT
CTACAAATTGGAGATCCGATCCATGATCAAGAAGGAAATCAAATCTCTATCATCACATATCGCCACAAAAAC
TACTATGCTCTAAGCGGAATCGGGTACGAGAGTCTAGACTTGTGTTTGGAAGGAGTAGGGATTCATCATCA
CGTACTTGAAACAGGAAACGCTGTATATGGAAAAGTTCAACATGATTATTCTACTATCAAAGAGAAGGCCA
AAGAAATGAATGCACTCAGTTCAGGACCTATCATCGATTACCACGTCTGGATAGGAGATTGTATCTGTCAAG
TTACTGCTGTGGACGTACATGGAAAGGAAATTATGAGAATGAGATTCAAAAAGGGTGCGGTGCTACAGAT
CCCAAATCTGGTAAAAGTTAAACTTGGGGAGAATGATACAGAAAATCTTTCTTCTACTATATCGGCGGCACC
ATCGAGGTAACCACCTCTCAAGAAGACCGCGTGAATAATGTACTCATGAAACGTTTGGAAACTATACGCCA
TATGTGGTCTGTTGTATATGATCATTTTGATATTGTGAATGGTAAAGAATGCTGTTATGTGCATACGCATTCAT
CTAATCAAAATCCTATACCGAGTACTGTAAAAACAAATTTGTACATGAAGACTATGGGATCATGCATTCAAAT
GGATTCCATGGAAGCTCTAGAGTATCTTAGCGAACTGAAGGAATCAGGTGGATGGAGTCCCAGACCAGAA
ATGCAGGAATTTGAATATCCAGATGGAGTGGAAGACACTGAATCAATTGAGAGATTGGTAGAGGAGTTCT
TCAATAGATCAGAACTTCAGGCTGGTAAATTAGTCAAATTTGGTAATTCTATTAATTGTTAAACATACATCTGT
TTCAGCTAAGCAACTAAGAACACGTATACGGCAGCAGCTTCCTTTTATACTCTCATCTTTTACCAACACAAA
GGGTGGATATTTGTTCATTGGAGTTGATAATAATACACACAAAGTATTTGGATTCACGGTGGGTTACGACTA
CCTCAGACTGATAGAGAATGATATAGAAAAGCATATCAAAAGACTTTGTGTTGTGCATTTCTGTGAGAAGA
AAGAGGACATCAAGTACACGTGTCGATTCATCAAGGTATATAAACCTGGGGATGAGGCTACCTCGACATAC

FIG. 11AZ

GTGTGCGCTATCAAAGTGGAAAGATGCTGTTGTGCTGTGTTTGCAGATTGGCCAGAATCATGGTATATGGA
TACTAATGGTATCAAGAAGTATTCTCCAGATGAATGGGTGTCACATATAAAATTTTAATTAATGTAACTATAGA
GAACAAATAATAGGTTGTAATATCATATAGACAATAACTAACAATTAATTAGTAACTGTTATCTCTTTTTTAACT
AACCAACTAACTATATACCTATTAATACATCGTAATTATAGTTCTTAACATCTATTAATCATTGATTCGCTTCTTT
AATTTTTTATAAACTAACATTGTTAATTGAAAAGGGATAACATGTTACAGAATATAAATTATATATGGATTTTT
TTAAAAAGGAAATACTTGACTGGAGTGTATATTTATCTCTTCATTATATAGCACGCGTGTGTTCCAATTCTTCC
ACATCCCATATAATACAGGATTATAATCTCGTTCGAACATACGAGAAAGTGGATAAAACAATAGTTGATTTTT
TATCTAGGTTGCCAAATTTATTCCATATTTTAGAATATGGGGAAAATATTCTACATATTTATTCTATGGATGATG
CTAATACGAATATTATAATTTTTTTTTCTAGATAGAGTATTAAATATTAATAAGAACGGGTCATTTATACACAATC
TCAGGTTATCATCATCCATTAATATAAAAGAATATGTATATCAATTAGTTAATAATGATCATCCAGATAATAGGA
TAAGACTAATGCTTGAAAATGGACGTAGAACAAGACATTTTTTGTCCTATATATCAGATACAGTTAATATCTAT
ATATGTATTTTAATAAATCATGGATTTTATATAGATGCAGAAGACAGTTACGGTTGTACATTATTACATAGATGT
ATATATCACTATAAGAAATCAGAATCAGAATCATACAATGAATTAATTAAGATATTGTTAAATAATGGATCCGA
TGTAGATAAAAAAGATACGTACGGAAACACACCTTTTATCCTATTATGTAAACACGATATCAACAACGTGGA
ATTGTTTGAGATATGTTTAGAGAATGCTAATATAGACTCTGTAGACTTTAATAGATATACACCTCTTCATTATGT
CTCATGTCGTAATAAATATGATTTTGTAAAGTTATTAATTTCTAAAGGAGCAAATGTTAATGCGCGTAATAAAT
TCGGAACTACTCCATTTTATTGTGGAATTATACACGGTATCTCGCTTATAAAACTATATTTGGAATCAGACACA
GAGTTAGAAATAGATAATGAACATATAGTTCGTCATTTAATAATTTTTGATGCTGTTGAATCTTTAGATTATCT
ATTATCCAGAGGAGTTATTGATATTAACTATCGTACTATATACAACGAAACATCTATTTACGACGCTGTCAGTT
ATAATGCGTATAATACGTTGGTCTATCTATTAAACAGAAATGGTGATTTTGAGACGATTACTACTAGTGGATG
TACATGTATTTCGGAAGCAGTCGCAAACAACAACAAAATAATAATGGAAGTACTATTGTCTAAACGACCATC
TTTGAAAATTATGATACAGTCTATGATAGCAATTACTAAAAATAAACAACATAATGCAGATTTATTGAAAATGT
GTATAAAATATACTGCGTGTATGACCGATTATGATACTCTTATAGATGTACAGTCGCTACAGCAATATAAATGG
TATATTTTAAAATGTTTCGATGAAATAGATATCATGAAGAGATGTTATATAAAAAATAAAACTGTATTCCAATT
AGTTTTTTGTATCAAAGACATTAATACTTTAATGAGATATGGTAAACATCCTTCTTTCGTGAAGTGCACTAGT
CTCGACGTATACGGAAGTCGTGTACGTAATATCATAGCATCTATTAGATATCGTCAGAGATTAATTAGTCTATT
ATCCAAGAAGCTGGATGCGGGAGATAAATGGTCGTGTTTTCCTAACGAAATAAAATATAAAATATTGGAAA
ACTTTAACGATAACGAACTATCCACATATCTAAAAATCTTATAAACACTATTAAAATATAAAATCTAAGTAGGA
TAAAATCACACTACATCATTGTTTCCTTTTAGTGCTCGACAGTGTATACTATTTTTAACACTCATAAATAAAAA
TGAAAACGATTTCCGTTGTTACGTTGTTATGCGTACTACCTGCTGTTGTTTATTCAACATGTACTGTACCCACT
ATGAATAACGCTAAATTAACGTCTACCGAAACATCGTTTAATGATAAACAGAAAGTTACATTTACATGTGATC
AGGGATATCATTCTTTGGATCCAAATGCTGTCTGCGAAACAGATAAATGGAAATACGAAAATCCATGCAAG
AAAATGTGCACAGTTTCTGATTATGTCTCTGAATTATATGATAAGCCATTATACGAAGTGAATTCCACCATGA
CACTAAGTTGCAACGGCGAAACAAAATATTTTCGTTGCGAAGAAAAAATGGAAATACTTCTTGGAATGAT
ACTGTTACGTGTCCTAATGCGGAATGTCAACCTCTTCAATTAGAACACGGATCGTGTCAACCAGTTAAAGAA
AAATACTCATTTGGGGAATATATGACTATCAACTGTGATGTTGGATATGAGGTTATTGGTGCTTCGTACATAA
GTTGTACAGCTAATTCTTGGAATGTTATTCCATCATGTCAACAAAAATGTGATATACCGTCTCTATCTAATGGA
TTAATTTCCGGATCTACATTTTCTATCGGTGGCGTTATACATCTTAGTTGTAAAAGTGGTTTTATACTAACGGG
ATCTCCATCATCCACATGTATCGACGGTAAATGGAATCCCATACTCCCAACATGTGTACGATCTAACGAAAAA
TTTGATCCAGTGGATGATGGTCCCGACGATGAGACAGATTTGAGCAAACTCTCGAAAGACGTTGTACAATA
TGAACAAGAAATAGAATCGTTAGAAGCAACTTATCATATAATCATAGTGGCGTTAACAATTATGGGCGTCATA
TTTTTAATCTCCGTTATAGTATTAGTTTGTTCCTGTGACAAAAATAATGACCAATATAAGTTCCATAAATTGCT
ACCGTAAATATAAATCCGTTAAAATAATTAATAATTTAATAACAAACAAGTATCAAAAGATTAAAGACTTATAG
CTAGAATCAATTGAGATGTCTTCTTCAGTGGATGTTGATATCTACGATGCCGTTAGAGCATTTTTTACTCAGGC

FIG. 11BA

```
ACTATTATAACAAGAGATTTATTGTGTATGGAAGAAGTAACGCCATATTACATAATATATACAGGCTATTTACA
AGATGCGCCGTTATACCGTTCGATGATATAGTACGTACTATGCCAAATGAATCACGTGTTAAACAATGGGTG
ATGGATACACTTAATGGTATAATGATGAATGAACGCGATGTTTCTGTAAGCGTTGGCACCGGAATACTATTC
ATGGAAATGTTTTTCGATTACAATAAAAATAGTATCAACAATCAACTAATGTATGATATAATTAATAGCGTATCT
ATAATTCTAGCTAATGAGAGATATAGAAGCGCTTTTAACGACGATGGTATATACATCCGTAGAAATATGATTA
ACAAGTTGTACGGATACGCATCTCTAACTACTATTGGCACGATCGCTGGAGGTGTTTGTTATTATCTGTTGAT
GCATCTAGTTAGTTTGTATAAATAATTATTTCAATATACTAGTTAAAATTTTAAGATTTTAAATGTATAAAAAAC
TAATAACGTTTTTATTTGTAATAGGTGCATTAGCATCCTATTCGAATAATGAGTACACTCCGTTAATAAACTG
AGTGTAAAACTCTATATAGATGGAGTAGATAATATAGAAAATTCATATACTGATGATAATAATGAATTGGTGTT
AAATTTTAAAGAGTACACAATTTCTATTATTACAGAGTCATGCGACGTCGGATTTGATTCCATAGATATAGAT
GTTATAAACGACTATAAAATTATTGATATGTATACCATTGACTCGTCTACTATTCAACGCAGAGGTCACACGTG
TAGAATATCTACCAAATTATCATGCCATTATGATAAGTACCCTTATATTCACAAATATGATGGTGATGAGCAAC
AATATTCTATTACTGCAGAGGGAAAATGCTATAAAGGAATAAAATATGAAATAAGTATGATCAACGATGATAC
TCTATTGAGAAAACATACTCTTAAAATTGGATCTACTTATATATTTGATCGTCATGGACATAGTAATACATATTA
TTCAAAATATGATTTTTAAAAATTTAAAATATATTATCACTTCAGTGACAGTAGTCAAATAACAAACAACACC
ATGAGATATATTATAATTCTCGCAGTTTTGTTCATTAATAGTATACACGCTAAAATAACTAGTTATAAGTTTGAA
TCCGTCAATTTTGATTCCAAAATTGAATGGACTGGGGATGGTCTATACAATATATCCCTTAAAAATTATGGCA
TCAAGACGTGGCAAACAATGTATACAAATGTACCAGAAGGAACATACGACATATCCGCATTTCCAAAGAAT
GATTTCGTATCTTTCTGGGTTAAATTTGAACAAGGCGATTATAAAGTGGAAGAGTATTGTACGGGACTATGC
GTCGAAGTAAAAATTGGACCACCGACTGTAACATTGACTGAATACGACGACCATATCAATTTGTACATCGAG
CATCCGTATGCTACTAGAGGTAGCAAAAAGATTCCTATTTACAAACGCGGTGACATGTGTGATATCTACTTGT
TGTATACGGCTAACTTCACATTCGGAGATTCTAAAGAACCAGTACCATATGATATCGATGACTACGATTGCAC
GTCTACAGGTTGCAGCATAGACTTTGTCACAACAGAAAAAGTGTGCGTGACAGCACAGGGAGCCACAGA
AGGGTTTCTCGAAAAAATTACTCCATGGAGTTCGAAAGTATGTCTGACACCTAAAAAGAGTGTATATACATG
CGCAATTAGATCCAAAGAAGATGTTCCCAATTTCAAGGACAAAATGGCCAGAGTTATCAAGAGAAAATTTA
ATAAACAGTCTCAATCTTATTTAACTAAATTTCTCGGTAGCACATCAAATGATGTTACCACTTTTCTTAGCATG
CTTAACTTGACTAAATATTCATAACTAATTTTTATTAATGATACAAAAACGAAATAAAACTGCATATTATACACT
GGTTAACGCCCTTATAGGCTCTAACCATTTTCAAGATGAGGTCCCTGATTATAGTCCTTCTGTTCCCCTCTATC
ATCTACTCCATGTCTATTAGACGATGTGAGAAGACTGAAGAGGAAACATGGGGATTGAAAATAGGGTTGTG
TATAATTGCCAAAGATTTCTATCCCGAAAGAACTGATTGCAGTGTTCATCTCCCAACTGCAAGTGAAGGATT
GATAACTGAAGGCAATGGATTCAGGGATATACGAAACACCGATAAATTATAAAAAAAGCAATGTGTCCGCT
GTTTCCGTTAATAATACTATTTTCGTAACTGGCGGATTATTCATAAATAACTCTAATAGCACGATCGTGGTTAA
CAATATGGAAAAACTTGACATTTATAAAGACAAACAATGGTCGATTATAGAAATGCCTATGGCTAGGGTATA
TCACGGCATCGACTCGACATTTGGAATGTTATATTTTGCCGGAGGTCTATCCGTTACCGAACAATATGGTAAT
TTAGAGAAAAACAACGAGATATCTTGTTACAATCCTAGAACGAATAAGTGGTTTGATATTTCATATACTATTT
ATAAGATATCCATATCATCATTGTGTAAACTAAATAACGTCTTCTATGTATTTAGTAAGGACATTGGATATGTG
GAAAGTATGATGGTGCATGGAAGTTAGTACATGATCGTCTCCCCGCTATAAAGGCATTATCAACTTCTCCTT
ATTGATTGAAAATGAAAATATAAATAGTTTTTATGTATAGCAGTATTACCCTATAGTTTTATTGCTTACTACTAA
CATGGATACAGATGTTACAAATGTAGAAGATATCATAAATGAAATAGATAGAGAGAAAGAAGAAATACTAA
AAAATGTAGAAATTGAAAATAATAAAAACATTAACAAGAATCATCCAAGTGGATATATTAGAGAAGCACTCG
TTATTAATACAAGTAGTAATAGTGATTCCATTGATAAAGAAGTTATAGAATGTATCAGTCACGATGTAGGAAT
ATAGATCATATCTACTAATTTTTATAATCGATACAAAACATAAAAAACAACTCGTTATTACATAGCAGGCATGG
AATCCTTCAAGTATTGTTTTGATAACGATGGCAAGAAATGGATTATCGGAAATACTTTATATTCTGGTAATTC
AATACTATATAAGGTCAGAAAAAAATTTCACTAGTTCGTTCTACAATTACGTAATGAAAATAGATCACAAATCA
```

FIG. 11BB

CACAAGCCATTGTTGTCTGAAATACGATTCTATATATCTGTATTGGATCCTTTGACTATCGACAACTGGACAC
GGGAACGTGGTATAAAGTATTTGGCTATTCCAGATCTGTATGGAATTGGAGAAACCGATGATTATATGTTCT
TCGTTATAAAGAATTCGGGAAGAGTATTCGCCCCAAAGGATACTGAATCAGTCTTCGAAGCATGCGTCACT
ATGATAAACACGTTAGAGTTTATACACTCTCGAGGATTTACCCATGGAAAAATAGAACCGAGGAATATACTG
ATTAGAAATAAACGTCTTTCACTAATTGACTATTCTAGAACTAACAAACTATACAAGAGTGGAAACTCACATA
TAGATTACAACGAGGACATGATAACTTCAGGAAATATCAATTATATGTGTGTAGACAATCATCTTGGAGCAA
CAGTTTCAAAACGAGGAGATTTAGAAATGTTGGGATATTGCATGATAGAATGGTTCGGTGGCAAACTTCCA
TGGAAAAACGAAAGTAGTATAAAAGTAATAAAACAAAAAAAAGAATATAAAAAATTTATAGCTACTTTCTTT
GAGGACTGTTTTCCTGAAGGAAATGAACCTCTGGAATTAGTTAGATATATAGAATTAGTATACACGTTAGAT
TATTCTCAAACTCCTAATTATGACAGACTACGTAAACTGTTTATACAAGATTGAAATTATATTCTTTTTTTATAG
AGTGTGGTAGTGTTACGGATATCTAATATTAATATTAGACTATCTCTATCGCGCTACACGACCAATATCGATTA
CTATGGATATCTTCAGGGAAATCGCATCTTCTATGAAAGGAGAGAATGTATTCATTTCTCCAGCGTCAATCTC
GTCAGTATTGACAATACTGTATTATGGAGCTAATGGATCCACTGCTGAACAGCTATCAAAATATGTAGAAAC
GGAGGAGAACACGGATAAGGTTAGCGCTCAGAATATCTCATTCAAATCCATGAATAAAGTATATGGGCGAT
ATTCTGCCGTGTTTAAAGATTCCTTTTTGAGAAAAATTGGCGATAAGTTTCAAACTGTTGACTTCACTGATT
GTCGCACTATAGATGCAATCAACAAGTGTGTAGATATCTTTACTGAGGGGAAAATCAATCCACTATTGGATG
AACCATTGTCTCCTGATACCTGTCTCCTAGCAATTAGTGCCGTATACTTTAAAGCAAAATGGTTGATGCCATT
CGAAAAGGAATTTACCAGTGATTATCCCTTTTACGTATCTCCGACGGAAATGGTAGATGTAAGTATGATGTC
TATGTACGGCAAGGCATTTAATCACGCATCTGTAAAGGAATCATTCGGCAACTTTTCAATCATAGAACTGCC
ATATGTTGGAGATACTAGTATGATGGTCATTCTTCCAGACAAGATTGATGGATTAGAATCCATAGAACAAAAT
CTAACAGATACAAATTTTAAGAAATGGTGTAACTCTCTGGAAGCTACGTTTATCGATGTTCACATTCCCAAGT
TTAAGGTAACAGGTTCGTATAATCTTGTGGATACTCTAGTAAAGTCAGGACTGACAGAGGTGTTCGGTTCA
ACTGGAGATTATAGCAATATGTGTAATTCAGATGTGAGTGTCGACGCTATGATTCACAAAACGTATATAGATG
TCAATGAAGAGTATACAGAAGCAGCTGCAGCAACTTGTGCACTGGTGTCAGACTGTGCATCAACAATTACA
AATGAGTTCTGTGTAGATCATCCGTTCATCTATGTGATTAGGCATGTTGATGGAAAAATTCTTTTCGTTGGTA
GATATTGCTCTCCGACAACTAATTGTTAACCATTTTTTTTAAAAAAATAGAAAAAACATGTGGTATTAGTGCA
GGTCGTTGTTCTTCCAATTGCAATTGGTAAGATGACGGCCAACTTTAGTACCCACGTCTTTTCACCACAGCA
CTGTGGATGTGACAGACTGACCAGTATTGATGACGTCAGACAATGTTTGACTGAATATATTTATTGGTCGTC
CTATGCATACCGCAACAGGCAATGCGCTGGACAGTTGTATTCCACACTCCTCTCTTTTAGAGATGATGCGGA
ATCAGTGTTCATCGACATTCGCGAGCTGGTAAAAAATATGCCGTGGGATGATGTCAAAGATTGTACAGAAA
TCATCCGTTGTTATATACCGGATGAGCAAAAAACCATCAGAGAGATTTCGGCCATCATCGGACTTTGTGCAT
ATGCTGCTACTTACTGGGGAGGTGAAGACCATCCCACTAGTAACAGTCTGAACGCATTGTTTGTGATGCTT
GAGATGCTCAATTACGTGGATTATAACATCATATTCCGGCGTATGAATTGATGAGTTGTACATCTTGACATTTT
CTTTCTTCTCTTCTCCCTTTCTTCTCTTCTCCCTTCCTCCCTCTTCTCCCTTTCCCAGAAACAAACTTTTTTACC
CACTATAAAATAAAATGAGTATACTACCTATTATATTTCTTCCTATATTTTTTTATTCTTCATTCGTTCAGACTTT
TAACGCGCCTGAATGTATCGACAAAGGGCAATATTTTGCATCATTCATGGAGTTAGAAAACGAGCCAGTAA
TCTTACCATGTCCTCAAATAAATACGCTATCATCCGGATATAATATATTAGATATTTTATGGGAAAACGAGGA
GCGGATAATGATAGAATTATACCGATAGATAATGGTAGCAATATGCTAATTCTGAACCCGACACAATCAGACT
CTGGTATTTATATATGCATTACCACGAACGAAACCTACTGTGACATGATGTCGTTAAATTTGACAATCGTGTC
TGTCTCAGAATCAAATATAGATCTTATCTCGTATCCACAAATAGTAAATGAGAGATCTACTGGCGAAATGGTA
TGTCCCAATATTAATGCATTTATTGCTAGTAACGTAAACGCAGATATTATATGGAGCGGACATCGACGCCTTA
GAAATAAGAGACTTAAACAACGGACACCTGGAATTATTACCATAGAAGATGTTAGAAAAAATGATGCTGGT
TATTATACATGTGTTTTAGAATATATATACAGAGGTAAAACATATAACGTAACCAGAATTGTAAAATTAGAGGT
ACGGGATAAAATAATACCTTCTACTATGCAATTACCAGATGGCATTGTAACTTCAATAGGTAGTAATTTGACT

FIG. 11BC

ATTGCGTGTAGAGTATCGTTGAGACCTCCCACAACGGATGCAGACGTCTTTTGGATAAGTAATGGTATGTAT
TACGAAGAAGATGATGGGGACGGAGACGGTAGAATAAGTGTAGCAAATAAAATCTATATGACCGATAAGA
GACGTGTTATTACATCCCGGTTAAACATTAATCCTGTCAAGGAAGAAGATGCTACAACGTTTACGTGTATGG
CGTTTACTATTCCTAGCATCAGCAAAACAGTTACTGTTAGTATAACGTGAATGTATGTTGTTACATTTCCATGT
CAATTGAGTTTATAAGAATTTTTATACATTATCTTCCAACAAACAATTGACGAACGTATTGCTATGATTAACTC
CCACGATACTATGCATATTATTAATCATTAACTTGCAGACTATACCTAGTGCTATTTTGACATACTCATGTTCTT
GTGTAATTGCGGTATCTATATTATTAAAGTACGTAAATCTAGCTATAGTTTTATTATTTAATTTTAGATAATATAC
CGTCTCCTTATTTTTAAAAATTGCCACATCCTTTATTAAATCATGAATGGGAATTTCTATGTCATCGTTAGTATA
TTGTGAACAACAAGAGCAGATATCTATAGGAAAGGGTGGAATGCGATACATTGATCTATGTAGTTTTAAAAC
ACACGCGAACTTTGAAGAATTTATATAAATCATTCCATCGATACATCCTTCTATGTTGACATGTATATATCCAG
GAATTCTTTTATTAATGTCAGGAAATGTATAAACTAAAACATTGCCCGAAAGCGGTGCCTCTATCTGCGTTAT
ATCCGTTCTTAACTTACAAAATGTAACCAATACCTTTGCATGACTTGTTTTGTTCGGCAACGTTAGTTTAAAC
TTGACGAATGGATTAATTACAATAGCATGATCCGCGCATCTATTAAGTTTTTTTACTTTAACGCCCTTGTATGT
TTTTACAGAGACTTTATCTAAATTTCTAGTACTTGTATGTGTTATAAATATAACGGGATATAGAACTGAATCAC
CTACCTTAGATACCCAATTACATTTTATCAGATCCAGATAATAAACAAATTTTGTCGCCCTAACTAATTCTATAT
TGTTATATATTTTACAATTGGTTATGATATCATGTAATAACTTGGAGTCTAACGCGCATCGTCGTACGTTTATAC
AATTGTGATTTAGTGTAGTATATCTACACATGTATTTTTCCGCACTATAGTATTCTGGACTAGTGATAAAACTAT
CGTTATATCTGTCTTCAATGAACTCATCGAGATATTGCTCTCTGTCATATTCATACACCTGCATAAACTTTCTAG
ACATCTTACAATCCGTGTTATTTTAGGATCATATTTACATATTTACGGGTATATCAAAGATGTTAGATTAGTTAA
TGGGAATCGTCTATAATAATGAATATTAAACAATTATATGAGGACTTTTACCACAAAGCATCATAAAAATGAG
TCGTCGTCTGATTTATGTTTTAAATATCAACCGCAAATCAACTCATAAAATACAAGAGAATGAAATATATACAT
ATTTTAGTCATTGCAATATAGACCATACTTCTACAGAACTTGATTTTGTAGTTAAAAACTATGATCTAAACAGA
CGACAACATGTAACTGGGTATACTGCACTACACTGCTATTTGTATAATAATTACTTTACAAACGATGTACTGA
AGATATTATTAAATCATGACGTAAATGTAACGATGAAAACCAGTAGCGGACGTATGCCTGTTTATATATTGCT
TACTAGATGTTGCAATATTTCACATGATGTAGTGATAGATATGATAGACAAAGATAAAAACCACTTATTACATA
GAGACTATTCCAACCTATTACTAGAGTATATAAAATCTCGTTACATGTTATTAAAGGAAGAGGATATCGATGA
GAACATAGTATCCACTTTATTAGATAAGGGAATCGATCCTAACTTTAAACAAGACGGATATACAGCGTTACAT
TATTATTATTTGTGTCTCGCACACGTTTATAAACCAGGTGAGTGTAGAAAACCGATAACGATAAAAAAGGCC
AAGCGAATTATTTCTTTGTTTATACAACATGGAGCTAATCTAAACGCGTTAGATAATTGTGGTAATACACCAT
TCCATTTGTATCTTAGTATTGAAATGTGTAATAATATTCATATGACTAAAATGCTGTTGACTTTTAATCCGAATT
TCAAAATATGTAATAATCATGGATTAACGCCTATACTATGTTATATAACTTCCGACTACATACAACACGATATTC
TTGTTATGTTAATACATCACTATGAAACAAATGTTGGAGAAATGCCGATAGATGAGCGTCGTATGATCGTATT
CGAGTTTATCAAAACATATTCTACACGTCCGGCAGATTCGATAACTTATTTGATGAATAGGTTTAAAAATATA
AATATTTATACCCGCTATGAAGGAAAGACATTATTACACGTAGCATGTGAATATAATAATACACACGTAATAGA
TTATCTTATACGTATCAACGGAGATATAAATGCGTTAACCGACAATAACAAACACGCTACACAACTCATTATA
GATAACAAAGAAAATTCCCCGTATACCATCGATTGTTTACTGTATATACTTAGATATATTGTAGATAAGAATGT
GATAAGATCGTTGGTGGATCAACTTCCATCTCTACCTATCTTCGATATAAAATCATTTGAGAAATTCATATCCT
ACTGTATACTTTTAGATGACACATTTTACGATAGGCACGTTAAGAATCGCGATTCTAAAACGTATCGATACGC
ATTTTCAAAATACATGTCGTTTGATAAATACGATGGTATAATAACTAAATGTCACGACGAAACAATGTTACTC
AAACTGTCCACTGTTCTAGACACTACACTATATGCAGTTTTAAGATGCCATAATTCGAAAAAGTTAAGAAGA
TACCTCAACGAGTTAAAAAAATATAATAACGATAAGTCCTTTAAAATATATTCTAATATTATGAATGAGAGATA
CCTTAATGTATATTATAAAGATATGTACGTGTCAAAGGTATATGATAAACTATTTCCTGTTTTCACAGATAAAA
ATTGTCTACTAACATTACTACCTTCAGAAATTATATACGAAATATTATACATGCTGACAATTAACGATCTTTATA
ATATATCGTATCCACCTACCAAAGTATAGTTGTATTTTTCTCATGCGATGTGTGTAAAAAAACTGATATTATATA

FIG. 11BD

```
AATATTTTAGTGCCGTATAATAAAGATGACGATGAAAATGATGGTACATATATATTTCGTATCATTATTGTTATT
GCTATTCCACAGTTACGCCATAGACATCGAAAATGAAATCACAGAATTCTTCAATAAAATGAGAGATACTCT
ACCAGCTAAAGACTCTAAATGGTTGAATCCAGCATGTATGTTCGGAGGCACAATGAATGATATAGCCGCTCT
AGGAGAGCCATTCAGCGCAAAGTGTCCTCCTATTGAAGACAGTCTTTTATCGCACAGATATAAAGACTATGT
GGTTAAATGGGAGAGGCTAGAAAAGAATAGACGGCGACAGGTTTCTAATAAACGTGTTAAACATGGTGAT
TTATGGATAGCCAACTATACATCTAAATTCAGTAACCGTAGGTATTTGTGTACCGTAACTACAAAGAATGGTG
ACTGTGTTCAGGGTATAGTTAGATCTCATATTAAAAAACCTCCTTCATGCATTCCAAAAACATATGAACTAGG
TACTCATGATAAGTATGGCATAGACTTATACTGTGGAATTCTTTACGCAAAACATTATAATAATATAACTTGGT
ATAAAGATAATAAGGAAATTAATATCGACGACATTAAGTATTCACAAACGGGAAAGAAATTAATTATTCATAA
TCCAGAGTTAGAAGATAGTGGAAGATACAACTGTTACGTTCATTACGACGACGTTAGAATCAAGAATGATAT
CGTAGTATCAAGATGTAAAATACTTACGGTTATACCGTCGCAAGACCACAGGTTTAAACTAATACTAGATCCA
AAAATCAACGTAACGATAGGAGAACCTGCCAATATAACATGCACTGCTGTGTCAACGTCATTATTGATTGAC
GATGTACTGATTGAATGGGAAAATCCATCCGGATGGCTTATAGGATTCGATTTTGATGTATACTCTGTTTTAA
CTAGTAGAGGCGGTATTACCGAGGCGACCTTGTACTTTGAAAATGTTACTGAAGAATATATAGGTAATACAT
ATAAATGTCGTGGACACAACTATTATTTTGAAAAAACCCTTACAACTACAGTAGTATTGGAGTAAATACACA
ATGCATTTTTATATACATTACTGAATAATTATTATTATTATTTATATCGTATTTGTGCTATAACGCGACTATCTAGG
TATTTGTATCTCACTGATAGAGAACATATAAATATAGACTCTATTAAACAGTTGTGTAAAATATCAAATCCTAAT
AGATGTGGATGTACGGCTTTACATGAGTACTTTTATAATTATAGATCAGTCAACGGAAAATACAAGTATAGAT
ACAACGGTTACTATCAATATTATTTATCTAGCGATTATGAAAATTATAATGAATATTATTATGATGATTATGATAG
AACTGGTATGAACAGTGAGAGTGATAATATATCAATCAAAACAGAATATGAATTCTATGATGAAACACAAGA
TCAAAGTACACAACTAGTAGGTTACGACATTAAACTCAAAACCAATGAGGATGATTTTATGGCTATGATAGA
TCAGTGGGTGTCCATGATTATATAGATGAATCAATTAATAAAGTAGTATATGGAAGAGAGTCTCACGTAAGAT
GGCGGGATATATGGCAAGAACATAATGATGGCGTATACAGTATAGGAAAGGAGTGCATAGATAATATATACG
AAGACAACCATACCGTAGACGAATTCTACAAGATAGACAGCGTATCAGATGTAGATGACGCGGAACACATA
TCTCCGATAACTAATGATGTATCTACACAAACATGGGAAAAGAAATCAGAGTTAGATAGATACATGGAAATG
TATCCTCGTCATAGATATAGTAAGCATTCTGTCTTTAAGGGATTTTCTGACAAAGTTAGAAAAAATGATTTAG
ACATGAATGTGGTAAAAGAATTACTTTCTAACGGTGCATCTCTAACAATTAAGGATAGCAGTAATAAGGATC
CAATAACCGTTTATTTTCGAAGAACGATAATGAATTTAGAAATGATTGATATTATTAACAAACATACAACTATT
GATGAACGAAAGTATATAGTACACTCCTATCTAAAAAATTATAAAAATTTCGATTATCCATTTTTCAGGAAGTT
AGTTTTGACTAATAAACATTGTCTCAACAATTATTATAATATAAGCGACAGCAAATATGGAACACCGCTACAT
ATATTGGCGTCTAATAAAAAATTAATAACTCCTAATTACATGAAGTTATTAGTGTATAACGGAAATGATATAAA
CGCACGAGGTGAAGATACACAAATGCGAACTCCATTACACAAATATTTGTGTAAATTTGTATATCATAATATT
GAATATGGTATCCGATACTATAATGAAAAGATTATAGACGCATTTATAGAGTTAGGAGCCGATCTAACTATTC
CAAATAACGATGGAATGATACCAGTAGTTTACTGTATACACTCAAATGCAGAATATGGTTATAACAATATTACT
AACATAAAGATAATACGTAAACTACTTAATCTTAGTAGACGTGCGTCACATAATCTATTTAGAGATCGAGTCA
TGCACGATTATATAAGTAATACATATATTGATCTTGAGTGTTTAGATATTATTAGATCGTTGGATGGATTCGATA
TCAATGGTTACTTTGAAGGACGTACACCACTTCATTGCGCTATACAACATAACTTCACTCAGATTGCTAAGTA
CTTATTAGATCGAGGAGCTGATATAGTCGTACCCAACACATTGATTATACATCAGTACATACAGTAAATAGCAT
AGATATGGAGGAGGATACAAATATTTCAAATAAAGTTATAAGGTACAACACTGTCAATAATATATGGAAGAC
ATTACCTAACTTCTGGACTGGAACTATAAATCCAGGCGTGGTCTCGCATAAAGATGATATATATGTTGTATGC
GACATCAAAGATGAAAAAAATGTTAAGACTTGTATATTTAGATATAACACGAATACGTATAACGGATGGGAA
TTGGTTACGACGACAGAAAGCAGATTATCAGCTCTGCATACTATTCTTCATGACAATACCATAATGATGTTAC
ATTGTTATGAATCGTATATGTTACAAGATACATTTAATGTGTACACTCGCGAATGGAATCATATGTGTCATCAA
CATTCGAATAGTTATATCATGTACAATATACTACCCATCTACTAAATATAATAGAATAAAATAAATGAGTATGAT
```

FIG. 11BE

CATTTTAGATAACGATTGATTTTATCATTACCGCTTCATTCTTATATTCTTTGCTTACGGAACCTATATTTAGAA
ACATCTACTAACGATTTTTTATGCTTGCATTATTAATGGTATGTAATATGATTGATTGTGTACGCAATACCAATT
TGTTAAGTATGAATACGGGGTACAAACATAAACTGAAATTTAACATTATTTATTTATGATATATATCGTTATCGT
TATTGTTTGGTCTATACCATGGATATCTTTAAAGAACTAATCTTAAAACACCCTGATGAAAATGTTTTGATTTC
TCCAGTTTCTATTTTATCTACTTTATCTATTCTAAATCATGGAGCAGCTGGTTCTACAGCTGAACAACTATCAA
AATATATAGAGAATATGAATGAGAATACACCCGATGATAAGAAGGATGACAATAATGACATGGACGTAGATA
TTCCGTATTGTGCGACACTAGCTACCGCAAATAAAATATACGGTAGCGATAGTATCGAGTTCCACGCCTCCTT
CCTACAAAAAATAAAAGACGATTTTCAAACTGTAAACTTTAATAATGCTAACCAAACAAAGGAACTAATCAA
CGAATGGGTTAAGACGATGACAAATGGTAAAATTAATTCCTTATTGACTAGTCCGCTATCCATTAATACTCGT
ATGACAGTTGTTAGCGCCGTCCATTTTAAAGCAATGTGGAAATATCCATTTTCTAAACATCTTACATATACAG
ACAAGTTTTATATTTCTAAGAATATAGTTACCAGTGTTGATATGATGGTGGGTACCGAGAATAACTTGCAATA
TGTACATATTAATGAATTATTCGGAGGATTCTCTATTATCGATATTCCATACGAGGGAAACTCTAGTATGGTAA
TTATACTACCGGACGACATAGAAGGTATATATAACATAGAAAAAAATATAACAGATGAAAAATTTAAAAAATG
GTGTGGTATGTTATCTACTAAAAGTATAGACTTGTATATGCCAAAGTTTAAAGTGGAAATGACAGAACCGTA
TAATCTGGTACCGATTTTAGAAAATTTAGGACTTACTAATATATTCGGATATTATGCAGATTTTAGCAAGATGT
GTAATGAAACTATCACTGTAGAAAAATTTCTACATACGACGTTTATAGATGTTAATGAGGAGTATACAGAAG
CATCGGCCGTTACAGGAGTATTTATGACTAACTTTTCGATGGTATATCGTACGAAGGTCTACATAAACCATCC
ATTCATGTACATGATTAAAGACAACACAGGACGTATACTTTTTATAGGGAAATACTGCTATCCGCAATAAATA
TAAACAAATAGACTTTTATCACGTTTATCTATGTCTAAATATTACAAATAGTAATAGTATAAACTAAAGCTGATA
ATACTTAAAAAAATAATAATATCATTTACAATTAATAGTATAAACTAAAAATTAAACAAATCGTTATTATAAGTA
ATATCAAAATGATGATATACGGATTAATAGCGTGTCTTATATTCGTGACTTCATCCATCGCTAGTCCACTTTATA
TTCCCGTTATTCCACCCATTACGGAAGATAAATCGTTCAATAGTGTAGAGGTATTAGTTTCCTTGTTTAGAGA
TGACCAAAAGACTATACGGTAACTTCTCAGTTCAATAACTACACTATCGATACCAAAGACTGGACTATCGG
CGTACTATCCACACCTGATGGTTTGGATATACCATTGACTAATATAACTTATTGGTCACGGTTTACTATAGGTC
GTGCATTGTTCAAATCAGAGTCTGAGGATATTTTCCAAAAGAAAATGAGTATTCTAGGTGTTTCTATAGAAT
GTAAGAAGTCGTCGACATTACTTACTTTTTTGACCGTGCGTAAAATGACTCGAGTATTTAATAAATTTCCAG
ATATGGCTTATTATCGAGGAGACTGTTTAAAAGCCGTTTATGTAACAATGACTTATAAAAATACTAAAACTGG
AGAGACTGATTACACGTACCTCTCTAATGGGGGGTTGCCTGCATACTATCGTAATGGGGTCGATGGTTGATT
ATTGATTAGTATATTCCTTATTCACACAAAAAGAACATTTTTATAAACATGAAACCACTGTCTAAATGTAATTA
TGATCTTGATTTATAGATGAAGATCAGCCTTTAGAGGATTTTAACCAGTATGTTTAATATGAAAAAAATAAAC
ATAACATATTTTGAGATTAAGCGCTATTGTGCTTAATTATTTTGCTCTATAAACTGAATATATAGCCACAATTAT
TGACGGGCTTGTTTATGACCGGCAATCATGAATTTACAGAAATTATCTCTGGCTATATATCTTACTGCGACAT
GTTCGTGGTGTTATGAAACATGCATAAGAAAAACTGCGTTGTATCATGACATTCAATTGGAGCATGTAGAAG
ACAATAAAGATAGTGTAGCGTCGCTACCGTACAAGTAGTCAATCAAAGAGAACGTAGTAGATTGTTGGCTA
CATTTAATTGGACAGATATAGCTGAGGGTGTTAGAAATGAGTTCATTAAAATATGTGATATCAACGGAACAT
ATTTATATAATTATACTATTGCTGTTAGTATAATTATTGA 3'

FIG. 12A

Parental virus (CF33)
Full J2R gene (534 bp) has been highlighted in Red (FIG. 12T)
Part of CF33 (J2R gene) deleted in HOV4, has been *italicized in bold*.

5'GAGAAAGAGATAAAACTTTTTTACGACTCCATCAGAAAGAGGTTTAATATTTTTGTGAGACCATCGAAGA
GAGAAAGAGAAAGAGATAGTTAGTCTAGATATTTTTCTTAGTACAAAAGTCAATGTTTTAAAATATATGGAC
AAGAATTTGTCTGTATAAAAACTTGTGTGAAATTTTGTACCAAAGAAAAAATGTGAGCAGTATCCCCTACAT
GGATTTTACTAGATCATTTATATACCAAAAAATATTATACGATCTACGTTTTATTATATGATTTTAACGTGTAAAT
TATAAACATTATTTTATGATATACAATTGTCTGGTAACCTAGATGGGCATAGGGGATGTTGATAAGCTCGACG
AGTATATGTTGTTGGACGTTATTGTTAAGAAATAGTTGATGCATCAGAAAGAGAATAAAAAATATTTTAGT
GAGACCATCGAAGAGAGAAAGAGATAAAACTTTTTTACGACTCCATCAGAAAGAGGTTTAATATTTTTGTG
AGACCATCGAAGAGAGAAAGAGAATAAAAATATTTTATGACTCCATTGAAGAGAGAAAGAGAAAATGAG
AATGAGAATAAAAATATTTTAGTGACACCATCAGAAAGAGGTTTAATATTTTTGTGAGACCATCGAAGAGA
GAAAGAGAATAAAAATATTTTATGACTCCATTGAAGAGAGAAAGAGAAAATGAGAATGAGAATAAAAATAT
TTTAGTGACACCATCAGAAAGAGGTTTAATATTTTTTATGAGACCATCAAAGAGAGAAAGAGAATAAAAAT
ATTTTTGTAAAACTTTTTTTATGAGACCATCAAAGAGAGAAAGAGAATAAAAATATTTTTGTAAAACTTTTT
TTATGAGACCATCAAAGAGAGAAAGAGAATAAAAATATTTTTGTAAAACTTTTTTTATGAGACCATCAAAG
AGAGAAAGAGAATAAAAATATTTTTGTAAAACTTTTTTTATGAGACCATCAAAGAGAGAAAGAGAATAAAA
ATATTTTTGTAAAACTTTTTTTATGAGACCATCAAAGAGAGAAAGAGAATAAAAAAATATTTTTGTAAAACT
TTTTTATGAGACCATCAGAAAGAGGTTTAATATTTTTGTGATACCCTGAAAGGAAATAGGAATAGGAATAG
TGTCATAATCGTATCACACTATTGAGACAGAAAAAGAAGAAGTCGCGAGAGGTAACTTTTTGTTTTGCAAA
CCGGAATATAGTGTCCGGTACACTTTTTTAATTCGTGGTGTGCCTGAATCGTTCGATTAACCCTACTCATCCA
ATTTCAGATGAATAGAGTTATCGATTCAGACACACGCTTTGAGTTTTGTTGAATCGATGAGTGAAGTATCAT
CGGTTGCACCTTCAGATGCCGATCCGTCGACATACTTGACCTCAAGTTCAGATGATTCCTTGCACATGTCTC
CGATACGAACGCTAAACTCTAGATTCTTGACACATTTTGTATCGACGATCGTTGAACCGATGATATCTTCGTA
ACTCACTTTCTTATGAGAGATGTTAGACCCGAGTACTGGATGGGTCTTGATGTCGCTGTCTTTCTCTTCTTCG
CTACATCTGATGTCGATAGACACCTCACAGTCTTTCCATCAGCGGATTCTGAGATGGATTTAATCTGAGGAC
ATTTGGTGAATCCAAAGTTCATTCTCAGACCTCCACCGATGATGGAGTAATAAGTGGTAGGAGGATCTACAT
CCTCGACTGATTCCACCTCGGGATCTGGATCTGACTCGGACTCTGTAATTTCCGTTACGGATTGGCAAATCT
TATCATCGGTCGGTGTTTGGTCTTGCTTTGTGACTTTGATAATAACATCGATTCCCATATGATGTTTGTTTTCT
TCTTCCGTACACGATGAGGATGATTGCTGAAGACTGGCAGGCACATGCATGCCAGTACGATATATTGTTTCA
TGATTGCTATTGATTGAGTACTGTTCTTTATGATTCTACTTCCTTACCGTGCAATAAATTAGAATATATTTTCTA
CTTTTACGAGAAATTAATTATTGTATTTATGGGTGAAAAACTTACTATAAAAAGCGGGTGGGTTTGGAATTA
GTGATCAGTTTATGTATATCGCAACTACCGGGCATATGGCTACATTACCCACATGATAAGAGATTGTATCAGT
TTCGTAGTCTTGAGTATTGGTATTACTATATAGTATATAGATGTCGACGCTAGAGTTACTGTCTCCGAATGCGG
CATGATAGTATCATTCTTTGCTTTCGTTAACTGTTTGGAGGAAGAATCTTTGTTATTGCATTTAATCTCGAAAT
TCAGAGTGCACACCTTTCTCCTGTAAAGAATCCTGAAGTTGCTACCTTATTAAGAACGGAGAAGTATCCATC
ACGAAAGACGGGATTACAGTCTTTATGATTCATAGTAATAGTTAGTTCCGACGTTGAGATGGATTCGCTGAG
ACCGGTAGTGGTCGTCCGAGTACACGATGTGTCGTTGACGGGATACAGATTAATTTCCACATCGATATAGTT
AAAGGTATTTCTGGGTACGGGTTTGAGATCGTCGTACATGGGAAATGAAATGTGACTGTCTGAATGTATGG
CTTTAAGATAGCTGTGATACCGTATACAGGTCGGTGTCGGAGATTCGAATCTCTTTAAGGCGACTTATGTCA
CGATGATGGAATCTATCTTATCGAATGATATATTTTTCATAAATACACTTTTATAGTCCTCGTTTAAACAGAATT
TACTATGTAGTTCCGCGAATGACTCGTCCCTTAATAGGCAGTAGGCTAGTATCTTTTTTACGTAGTAATCGTC

FIG. 12B

GTAGGGAGAGACATCTTGTAGAACAACGATTTAATCATAGGTAGAGATACTTTCAGTCTGTGGTGGATGAT
GTCATTCACAACATCCGCCTTGTATATGATGTTTCTGTTTTCAAACACCAAGTCGAATACCGTCTTTAGTCGG
AAGGTTGATGTCGTATCCGATGTATGAGGCAACATTGTTGTTACAATTTTGAAAGGCGGTATTATAGTATTCG
TCTTTCTGAATGTCGAACCTATCTAGTAGATACCGTAGTATATTGAGAGTGTATCCTTGATTATGTTTTATGAA
TAGATAAAGTAGATGTTGTCCTTCTTCCTTTTGTTCGTGCCAATTGAGTAACATTATGAGAATATGACCTGTT
GCACAATCGTTCCATGATGGGTGTACAATCAAGATTATTACGTATCCTCGTATCGGCTCCTCGAGATAAAAGA
GCATACACCACACGAGGACTATGTTTGGTATACTGTTGAAGGTAAGTGTGTAACCGCGTTAATGTTTGCTCC
ATAATCTATTATCGCGTAGATGAATCGCTTCTCGGCTCGCATCTTAGTGTGACTTAACTTGTAATAATTGCTTT
TGTAGAACGTGGATATGTGTTTACAGTAGTAATGAAGAGAAGTGAGTCCATCCTCGTCGACGCAATTAGGG
TCGGATCCTTTGTACAGAACGTAATAGTTTAAGCTCCCATTGAATTTATATCTAAGATAACACAGCAATAGAT
CGGATGATTTACTAAAGTCATCAATGGTGTCCGTTAGTATATCAAAGATCTTGTTATCGATTGATAGTGAATG
AATCAGATAGTGGTGTAGAGGAATATGTCCTTTTTCATCCTTGCTATCAAAGTTACGCATGCCGTGGTGTAA
CAATATCTTTAATACAGATGGATTAAATCGTGTATTCATCGTATAGCAATGTAATGGAGAGTTACCTCGTTTAT
TCAGATCGCAGTGTTTAATAACTAGCTTAAACAGATGAGACGATGTATCCACATCAAAGAACGTAAAATACA
TATGACAAACATTGTTGACAGAAACGTGACCTTCATTCTTACCGTCGTCCATAAATACGTTAGGTATGTACCA
CATACTGTCGCGAACGATGCGTACAATCTCGTCCATCTCATAATGATTTACTTTTTCATAATTAAAGATGTGAA
AGAAAAACAGAACAATATATTTTTTTAGTAATGTTTATGCGAGACATATAAAATAAACTCCGTGTTTATGATC
ATTTTTAACAGCAACACATTCAATATTGTATTGTTATTTTTATATTATTTACACAATTAACAATATATTATTAGTT
TATATTACTGAATTAATAATATAAAATTCCCAATCTTGTCATAAACACACACTGAGAAACAGCATAAACACAA
AATCCATCAAAAATGTCGATGAAATATCTGATGTTGTTGTTCGCTGCTATGATAATCAGATCATTCGCCGATA
GTGGTAACGCTATCGAAACGACATCGCCAGAAATTACAAACGCTACAACAGATATTCCAGCTATCAGATTAT
GCGGTCCAGAGGGAGATGGATATTGTTTACACGGTGACTGTATCCACGCTAGAGATATTGACGGTATGTATT
GTAGATGCTCTCATGGTTATACAGGCATTAGATGTCAGCATGTAGTATTAGTAGACTATCAACGTTCAGAAAA
CCCAAACACTACAACGTCATATATCCCATCTCCCGGTATTATGCTTGTATTAGTAGGCATTATTATTATTACGTG
TTGTCTATTATCTGTTTATAGGTTCACTCGACGAACTAAACTACCTATACAAGATATGGTTGTGCCATAATTTT
TATAAATTTTTTTATGAGTATTTTTACAAAAAAAATGTATAAAGTGTATGTCTTATGTATATTTATAAAAATGCT
AAGTATGCGATGTATCTATGTTATTTGTATTTATCTAAACAATACCTCTACCTCTAGATATTATACAAAAATTTTT
TATTTCGGCATATTAAAGTAAAATCTAGTTACCTTGAAAATGAATACAGTGGGTGGTTCCGTATCACCAGTAA
GAACATAATAGTCGAATACAGTATCCGATTGAGATTTTGCATACAATACTAGTCTAGAAAGAAATTTGTAATC
ATCTTCTGTGACGGGAGTCCATATATCTGTATCATCGTCTAGTTTATCAGTGTCCCATGCTATATTCCTGTTATC
ATCATTAGTTAATGAAAATAACTCTCGTGCTTCAGAAAAGTCAAATATTGTATCCATACATACATCTCCAAAAC
TATCGCTTATACGTTTATCTTTAACGATACCTATACCTAGATGGTTATTTACTAACAGACATTTTCCAGATCTAT
TGACTATAACTCCTATAGTTTCCACATCAACCAAGTAATGATCATCTATTGTTATATAACAATAACATAACTCTT
TTCCATTTTTATCAGTATGTATATCTATATCAACGTCGTCGTTGTAGTGAATAGTAGTCATTGATCTATTATATGA
AACGGATATGTCTAGAACGGCAATTGTTTTACGTCCAGTTAACACTTTCTTTGATTTAAAGTCTAGAGTCTTT
GCAAACATAATATCCTTATCCGACTTTATATTTCCTGTAGGGTGGTATAATTTTATTTTGCCTCCACATATCGGT
GTTTCCAAATATATTACTAGACAATATTCCATATAGTTATTAGTTAAGGGTACCCAATTAGAACACGTACGCTT
ATTATCATCATTTGGATCGTATTTCATAAAAGTTATTGTACTATCGATGTCAACACATTCTACATTTTTTAATCG
TCTATATAGTATTTTTCTGATATTTTCTATAATATCAGAATTGTCTTCCATCGGAAGTTGTATACTATCGGAATCA
GTTACATGTTTAAATAATTCTCTGATGTCATTCCTTATACAATCAAATTCATTATTAAACAGTTTAATAGTCTGT
AGACCTTTATCGTCGTAAATATCCATTGTCTTATTAGTTACGCTTATTTTTATGTGTTTTACGTTGCTTTATTATA
TTTTATAAGAATGATTGTTTGACGAATCACGAGAACTATTAAGACACATTATTAGGTATATATTATAAAAAAGT
TTTTGATTACGATGTTATAAGAGGAAAGAGGACACATTAACATCATACATCAATTAACTACATTCTTATAACAT
CGTAATCAAAAGAATTGCAATTTTGATGTATAACAACTGTCAATGGGTTATGGAATTGTATATTACATATTATA

FIG. 12C

CGGTATGTTGGTAACGACAAATACCGATCGGTAATTGTCTGCCGGTGTAATAGAATTATATATATCTATCTATT
ACACCGGCTGAGTATGCATAATAATAAGTTGTGGTAGTATGATCTCCATATTTATAATTTAGGACTTTGTATTC
AGTATTTTTGGAATCATAAAAAATAAAAAAAAGTTTTACTAATTTAAAATTTAAAAAGTATTTACATTTTTTTC
ACTGTTTAGTCGCGGATATGGAATTCGATCCTGCCAAAATCAATACATCATCTATAGATCATGTAACAATATTA
CAATACATAGATGAACCAAATGATATAAGACTAACAGTATGCATTATCCGAAATATTAATAACATTACATATTAT
ATCAATATCACAAAAATAAATACACATTTGGCTAATCAATTTCGGGCTTGGAAAAAACGTATCGCCGGAAGG
GACTATATGACTAACTTATCTAGAGATACAGGAATACAACAATCAAAACTTACTGAAACTATACGTAACTGTC
AAAAAAATAGAAACATATATGGTCTATATATACACTACAATTTAGTTATTAATGTGGTTATTGATTGGATAACC
GATGTGATTGTTCAATCAATATTAAGAGGGTTGGTAAATTGGTACATAGCTAATAATACCTATACTCCAAATAC
ACCCAATAATACAACAACCATTTCTGAGTTGGATATCATCAAAATACTGGATAAATACGAGGACGTGTATAGA
GTAAGTAAAGAAAAAGAATGTGGAATTTGCTATGAAGTTGTTTACTCAAAAcgatagatactttggtttattggattc
gtgtactcatatattttgcataacatgcatcaatatatggcataaaacacgaagagaaaccggtgcgtcggataattgtcctatatgtcgtac
ccgttttagaaacataacaatgagcaagttctataagctagttaactaataaataaaaagtttaatttgttgacgacgtatgtcgttatttttct
cgtatgaaagattaaattcaattcaattcgttgtttctaatataatctgccgtattggatggattctcaagacaattgcatttagattatattatc
atgaataaaaatagtagcacgcactacttcagccaaatattcttttttgaaacgccatctatcgtagtgaggacacaagtgaacctataatta
tcaaatttattagtatcagtcacatgaaggactttctgtagagtgacgattctaccatctatggtactaacggtttcatcctccttgataccctc
acccaaatgttctataaatttagcatcctcgtccgatctcatatcctttgccaaccaatacatgtagctaaaattaggcataaatttcacacat
ccagtgcaacgaaattctccagaagatgttacgatgtttaggttaggacatttgatttcgtcggcattaacatatgggtgaacacacccatac
atgaaagcgatgagaaataggattctcatcttgccaaaatatcactagaaaaaatttatttatcaattttaaaggtataaaaaatacttattg
ttgctcgaatattttgtatttgatggtatacggaagattagaaatgtaggtattatcatcaactgattctatggttttatgtattctatcatgtttca
ctattgcgtcggaaataatatcatatgcttccacatatattttattttgttttaactcataatactcacgtaattctggattattggcatatctatg
aataattttagctccatgatcagtaaatattaatgagaacatagtattaccacctaccattattttttcatttcgttcaattcttgattgcaaaga
tctatataatcattatagcgttgacttatggactctggaatcttagacgatgtacagtcatctataatcatggcatatttaatacattgttttata
gcatagtagttatctacgatgttagatatttctctcaatgaatcaatcacacaatctaatgtaggtttatgacataatagcatttttcagcagttc
aatgtttctagattcgttgatggcaatggctatacatgtatatccgttatttgatctaatgttgacatctgaaccggattctagcagtaaagata
ctagagattgtttattatatctaacagccttgtgaagaagtgtttctcctcgtttgtcaatcatgttaatgtctttaagataaggtaggcaaatgt
ttatagtactaagaattgggcaagcataagacatgtcacaaagacccttttttgtatgtataagtgtaaaaattataacattcatagttggattt
acataggtgtccaatcgggatctctccatcatcgagataattgatggcatctcccttccttttttagtagatatttcatcgtgtaagaatcaatat
taatatttctaaagtattcgtgtatagcctctttatttaccacagttccatattccactagagggatatcgccgaatgtcatatactcaattagta
tatgttggaggacatccgagttcattgttttcaatatcaaaaagatggtttccttatcatttctccatagtggtacaatactacacattattccgt
gcggctttccatttttccaaaaacaatttgaccaaatctaaatctacatctttattgtatctataatcactatttagataatcagccataattactc
gagtgcaacatgttagatcgtctatatatgaataagcagtgttatctattcctttcattaacaatttaacgatgtctatatctatatgagatgact
taatataatattgaagagctgtacaatagtttttatctatagaagacggcttgattccgtgattaattagacatttaacaacttccggacgcac
atatgctctcgtatccgactttgaatacagatgagagatgatatacagatgcaatacggtaccgcaatttcgtagttgataatcatcatacgc
gtatcagtactcgtcctcataaagaacactgcagccattttctatgaacaaatcaataattttaggaacaggatcattgtcattacataatttt
ctataactgaacgatggttttcacatttaacactcaagtcaaatccatgttctaccaacacctttatcaagtcaacgtctacatttttggatttc
atatagctgaatatattaaagtcatttatgttgctaaatccagtggcttctagtagagccatcgctatatcctttaactttaacatgtctactatt
tgtgtattcttctaatggggtagctgtctccaatttttgcgtaatggattagtgccactgtctagtagtagtttgacgacctcgacattattacaa
tgctcattaaaaaggtatgcgtgtaaagcattattcttgaattggttcctggtatcattaggatctctgtctctcaacatctgtttaagttcatcg
agagccacctcctcattttccagatagtcaaacattttgactgaatgagctactgtgaactctatacacccacacaactaatgtcattaaatat
tatttttttgaatgtatttataccatgtcaaaaacttgtacaattattaataaaaataatttagtgtttaaattttaccagttccagattttacacct
ccgttaaccccacttttttacaccactggacgatcctcctccccacattccaccgccaccagatgtataagttttagatcctttattactaccatc
atgtccatggataaagacactccacatgccgccactactaccccctttagaagacatattaataagacttaaggacaagtttaacaataaa
attaatcacgagtaccctactaccaacctacactattatatgattatagtttctattttttacagtaccttaactaaagtctctagtcacaagagc

FIG. 12D aatactaccaacctacactattatatgattatagtttctatttttataggaacgcgtacgagaaaatcaaatgtctaatttctaacggtagtgtt
gataaacgattatcgtcaatggatacctcctctatcatgtcgtctattttcttactttgttctattaacttattagcattatatattatttgattataa
aacttatattgcttattagcccaatcgtgtaaatatcggattattaacatatcgtttctttgtaggtttatttaacatgtacatcactgtaagcatgt
ccgtaccatttattttaatttgacgcatatccgcaatttctttttcgcagtcggttataaattctatatatgatggatacatgctacatgtgtactt
ataatcgactaatatgaagtacttgatacatattttcagtaacgatttattattaccacctatgaataagtacctgtgatcgtctaggtaatcaa
ctgttttcttaatacattcgatggttggtaatttactcagaataatttccaatatcttaatatataattctgctatttctgggatatatttatctgcc
agtataacacaaatagtaatacatgtaaacccatattttgttattatattaatgtctgcgccattatctattaaccattctactaggctgacact
atgcgacttaatacaatgataaagtatactacatccatgtttatctattttgtttatatcatcaatatacggcttacaaagttttagtatcgataa
cacatccaactcacgcatagagaaggtagggaataatggcataatatttattaggttatcatcattgtcattatctacaactaagtttccatttt
ttaaaatatactcgacaactttaggatctctattgccaaatttttgaaaatatttatttatatgcttaaatctatataatgtagctccttcatcaat
catacatttaataacattgatgtatactgtatgataagatacatattctaacaatagatcttgtatagaatctgtatatcttttaagaattgtgg
atattaggatattattacgtaaactattacacaattctaaaatataaaacgtatcacggtcgaataatagttgatcaactatataattatcgat
tttgtgattttttcttcctaaaactgtttacgtaaatagttagatagaatattcattagttcatgaccactatagttactatcgaataacgcgtcaaa
tatttcccgtttaatatcgcatttgtcaagataataatagagtgtggtatgttcacgataagtataataacgcatctcttttttgtgtgaaattaa
atagtttatcacgtccaaagatgtagcataaccatcttgtgacctagtaataatataataatagagaactgttttacccattctatcatcataa
tcagtggtgagtcgtaatcgtaatcgtctaattcatcatcccaattataatattcaccagcacgtctaatctgttctattttgatcttgtatccat
actgtatgttgctacatgtaggtattcctttatccaataatagtttaaacacatctacattgggatttgatgttgtagcgtatttctctacaatatt
aataccatttttgatactatttatttctatacctttcgaaattagtaatttcaataagtctatatcgatgttatcagaacatagatattcgaatata
tcaaaatcattgatattttatagtcgactgacgacaataacaaaatcacaacatcgttttttgatattattatttttcttggtaacgtatgcccttta
atggagtttcaccatcatactcatataatggatttgcaccactttctatcaatgattgtgcactgctggcatcgatgttaaatgttttacaactat
catagagtatcttatcgttaaccatgattggttgttgatgctatcgcatttttttggtttctttcatttcagttatgtatggatttagcacgtttggga
agcatgagctcatatgatttcagtactgtagtgtcagtactattagtttcgatcagatcaatgtctagatctatagaatcaaaacacgataggt
cagaagataatgaatatctgtacgcttcttttttgtactgtaacttctggttttgttagatggttgcatcgtgctttaacatcaatggtacaaatttt
atcctcgctttgtgtatcatattcgtctctagtataaaattctatattcagattatcatgcgatgtgtatacgctaacggtatcaataaacggag
cacaccatttagtcataacagtaatccaaaattttttaaagtatatcttaacgaaagaagttgtgtcattgtctacggtgtatggtactagatc
ctcataagtgtatatatctagagtaatgtttaatttattaaatggttgataatatggatcctcatgacaatttccgaagatggaaatgagatat
agacatgcaataaatctaatcgaagacatggttactccttaaaaaaaatacgaataatcaccttggctatttagtaagtgtcatttaacactat
actcatattaatccatggactcataatctctatacggggattaacggatgttctatatacgggggatgagtagttttcttctttaactttatactttt
actaatcatatttagactgatgtatgggtaatagtgtttaaagagttcgttctcatcatcagaataaaatcaatatctctgtttttttttgttatacag
atgtattacagcctcatatatattacgtaatagaacgtgtcatctacccttattaactttcaccgcatagttgtttgcaaatacggttaatccttttgac
ctcgtcgatttccgaccaatctgggcgtataatgaatctaaactttaatttcttgtaatcattcgaaataattttttagtttgcatccgtagttatcc
cctttatgtaactgtaaatttctcaacgcgatatctccattaataatgatgtcgaattcgtgctgtatacccatactgaatggatgaactaacg
aatatcaacggcgttaatagtaatttacttttttcatctttacatattgggtactagttttactatcataagtttataaattccacaagctactatgg
aataagccaaccatcttagtataccacacatgtcttaaagtttattaattaattacatgttgtttatatatatcgctacgaatttaaagagaaa
tcagtttaggaagaaaaaaattatctatctacatcatcacgtctctgtattctacgatagagtgctactttaagatgagacatatccgtgtcat
caaaaatatactccattaaaatgattattccggcagcgaacttgatattggatatatcacaacctttgttaatatctacgacaatagacagca
gtcccatggttccataaacagtgagtttatctttctttgaagcgatagtttgtagagatcttataaaaccgtcaaacgacatcgcatttatatct
ttagctaattcatatatgttaccatcgtaatatctaaccgcgtctatcttaaacgtttccatcgctttaaagacgtttccgatagatggtctcattt
catcagtcatactgagccaacaaatataatcgtgtataacatctttgatagaatcagactctaaagaaaacgaatcggctttattatacgcat
tcatgataaacttaatgaaaaatgttttcgttgtttaagttggatgaatagtatgtcttaataattgttattatttcattaattaatatttagtaac
gagtacactctataaaaacgagaatgacataactagttatcaaagtgtctaggacgcgtaattttcatatggtatagatcctgtaagcattgt
ctgtattctggagctattttctttatcgcattagtaagttcagaatatgttataaatttaaatcgaataacgaacatgactttagtaaagtcgtct
atattaactcttttattttctagccatcgtaataccatgtttaagatagtatattctctagttactacgatctcatcgttgtctagaatatcacata
ctgaatctacatccaattttagaaattggtctgtgttacatatctcttctatattattgttgatgtattgtcgtagaaaactattacgtagaccatt

FIG. 12E ttctttataaaacgaatatatagtactccaattatctttaccgatatatttgcacacataatccattctctcaatcactacatctttaagattttcg
ttgttaagatatttggctaaactatataattctattagatcatcaacagaatcagtatatattttctagatccaaagacgaactctttggcgtc
ctctataatattcccagaaaagatattttcgtgttttagtttatcgagatctgatctgttcatatacgccatgattgtacggtacgttatgataac
cgcataaaataaaaatccattttcatttttaaccaatactattcataattgagattgatgtaatactttgttactttgaacgtaaagacagtaca
cggatccgtatctccaacaagcacgtagtaatcaaatttggtgttgttaaacttcgcaatattcatcaatttagatagaaacttatactcatca
tctgttttaggaatccatgtattattaccactttccaacttatcattatcccaggctatgtttcgtccatcatcgttgcgcagagtgaataattcttt
tgtattcggtagttcaaatatatgatccatgcatagatcggcaaagctattgtagatgtgattttcctaaatctaatataaaactcgtttacta
gcaaacactttcctgatttatcgaccaagacacatatggtttctaaatctatcaagtggtggggatccatagttatgacgcagtaacatagat
tattacattcttgactgtcgctaatatctaaatatttattgttatcgtattggattctgcatatagatggcttgtatgtcaaagatatagaacaca
taaccaatttatagtcgcgctttacattctcgaatctaaagttaagagatttagaaaacattatatcctcggatgatgttatcactgtttctgga
gtaggatatattaaagtctttacagatttcgtccgattcaaatataacactaaataatatcccacattatcatctgttagagtagtatcattaaa
tctattatattttatgaaagatatatcactgctcacctctatatttcgtacatttttaaactgtttgtataatatctctctgatacaatcagatatat
ctattgtgtcggtagacgataccgttacatttgaattaatggtgttccattttacaacttttaacaagttgaccaattcatttctaatagtatcaa
actctccatgattaaatattttaatagtatccattttatatcactacggacacaaagtagctgacataaaccattgtataattttatgttttatgt
ttattagcgtacacattttggaagttccggcttccatgtatttcctggagagcaagtagatgatgaggaaccagatagtttatatccgtacttg
cacttaaagtctacattgtcgttgtatgagtatgatcttttaaacccgctagacaagtatccgtttgatattgtaggatgtggacatttaacaat
ctgacacgtgggtggatcggaccattctcctcctgaacacaggacaccagagttaccaatcaacgaatatccactattgcaactataagtta
caacgctcccatcggtataaaaatcctcgtatccgttatgtcttccgttggatatagatggaggggattggcatttaacagattcacaaatag
gtgcctcgggattccataccatagatccagtagatcctaattcacaatacgatttagattcACCGATCAACTGATATCCGCTATTAC
AAGAGTACGTTATACTAGAGCCAAAGTCTACTCCGCCAATAtcaagttggccattatcgatatctcgaggcgatgggcatc
tccgtttaatacattgattaaagagtgtccatccagtacctgtacatttagcatatataggtcccatttttttgctttctgtatccaggtagacata
gatattctatagtgtctcctatgttgtaattagcattagtttccacactattcttaaattttatattaatgggacgtgaaggaataggacagtatg
atagaacgcatcctattcccaacaatgtcaggaacgtcacgctctccaccttcatatttatttatccgtaaaaatgttatcctggacatcgtac
aaataataaaaaagcccatatatgtttgctattgtagaaattgtttttcacagttgctcaaaaacgatggcagtgacttatgagtttcatcttta
gtaaacatatcataatattcgatattacgagttgacatatcgaacaaattccaagtatttgattttggataatattcgtattttgcatctgctata
attaagatataatcaccgcaagaacacacgaacatctttcctacatggttaaagtacatgtaTaattctatccatttgtcttccttaactatata
tttgtatagataattacgagtctcAtAagtaattccagtaattGcatagatgtcAccAtcgtactctacagcataaactatactatgatgtct
aggcatgggagacttttttatccaacgattttagtgaaacattcTacatcgtttaatactacatatttCtcatacgtggtataaactccaccca
ttacatatatatcatcgtttacgaataccgacgcgcctgaatatctaggagtaattaagtttggaagtcttatccatttcgaagtgccgtgtttc
aaatattctgccacacccgttgaaatagaaaattctaatcctcctattacatataactttccatcgttaacacaagtactaacttctgattttaa
cgacgacatattagtaaccgttttccatttttcgttttaagatctacccgcgatacggaataaacatgtctattgttaatcatgccgccaataa
tgtatagacaattatgtaaaacatttgcattatagaattgtctatctgtattaccgactatcgtccaatattctgttctaggagagtaatgggtt
attgtggatatataatcagagtttttaatgactactatattatgttttataccatttcgtgtcactggctttgtagatttggatatagttaatccca
acaatgatatagcattgcgcatagtattagtcataaacttgggatgtaaaatgttgatgatatctacatcgtttggattttatgtatccacttta
ataatatcatagctgtaacatcctcatgatttacgttaacgtcttcgtgggataagatagttgtcagttcatcctttgataattttccaaattctg
gatcggatgtcaccgcagtaatattgttgattatttctAacatcgacgcattatatagtttttttaattccatatTGtttagaaaagtaaacatc
cttatacaatttgtggaattaatattatgaatcatagtttttacacatagatctactacaggcgtaacatcaattattacggcagcaactagtat
catttctacattgtttatggtgatgtttatcttcttccagcgcatatagtctaatagcgattcaaacgcgtgatagtttataccattcaatataatc
acttcatcatttatatggtgctcctgaatGcgtttaaaaaaaattatacggagaCgccgtaataatttccttattcacttgtataatttccccatt
gatagaaaaTAtcacgctttccattcttgaagtactataagtaattatagtataatgtaaacgtttatatattcaatatttttataaaaatcattt
tgacattaattcctttttaaatttccgtctatcatctatagaaacgtattctatgaatttataaaatgcttttacgtgtcctatcgtaggcgataga
accgctaaaaagcctatcgaatttctacaaaagaatctAttatatggtataggtgagagtataaaacattaaatgcccgtacttattaaagta
ttcagtagccaatcctaactcttcgaatacttattaatggctcttgttctgtacgaatctatttttttgaacaacggacctagtggtatatcttgt
tctatgtatctaaaataatgtctgactagatccgttagtttaatatcctcagtcatcttgtctagaatggcaaatctaactgcgggtttaggctttt

FIG. 12F agtttagtttttatatctacatctatgtctttatctaacaccaaaaatataatagctaatattttattacaatcatccggatattcttctacgatctc
actaactaatgtttctttggttatactagtatagtcacgatcagacaaataaagaaaatcagatgatcgatgaataatacatttaaattcatc
atctgtaagattttgagatgtctcattaaaatattattagggttagtactcattatcattCggcagctattacttattttattattttttcaccatat
agatcaatcattagatcatcaaaatatgtttcaatcatcctaaagagtatggtgaatgactcttcccatctaatttctgaacgttcaccaatgt
ctctagccactttggcactaatagcgatcattcgcttagcgtcttctatattattaactggttgattcaatctatctagcaatggaccgtcggac
agcgtcattctcatgttcttaatcaatgtacatacatcgccgtcatctaccaattcatccaacaacataagctttttaaaatcatcattataata
ggtttgatcgttgtcatttctccaaagaatatatctaataagtagagtcctcatgattagttaacaactattttttatgttaaatcaattagtaca
ccgctatgtttaatacttattcatattttagttttttaggattgagaatcaatacaaaaaattaatgcatcattaattttagaaatacttagtttcca
cgtagtCaatgaaacatttgaactcatcgtacaggacgttctcgtacaggacgtaactataaaccggtttatatttgttcaagatagatacaa
atccgataactttttttacgaattctacgggatccactttaaaagtgtcataccgggttctttttattcttttaaacagatcaatggtgtgatgttg
attaggtcttttacgaatttgatatagaatagcgttcacatatcctccataatggtcaatcgccatttgttcgtatgtcataaattctttaattata
tgacactgtgtattatttagttcatccttgttcatcattaggaatctatccaaaatggcaattatactagaactataggtgcgttgtatacacat
attgatgtgtctgtttatacaatccatgatatttggatccatgctactaccttcgggtaaaattgtagcatcatataccatttctagtactttagg
ttcattattatccattgcagaggacgtcatgatcgaatcAtaaaaaaaatatattattttttatgttattttgttaaaaataatcatcgaatacttcg
taagatactccttcatgaacataatcagttacaaaacgtttatatgaagtaaagtatctacgattttttacaaaagtccggatgcataagtaca
aagtacgcgataaacggaataataatagatttatctagtctatctttttctatagctttcatagttagatacatggtctcagaagtaggattatg
taacatcagcttcgataaaatgactgggttatttagtcttacacattcgctcatacatgtatgaccgttaactacaGagtctacactaaaatg
attgaacaatagatagtctaccattgtttcgtattcagatagtacagcgtagtacatGgcatcttcacaaattatatcattgtctaatagatatt
tgacgcatcttatggatcccacttcaacagccatcttaaaatcggtaAaatcatattgctttcctttatcattaataatttctaaaacatcatct
ctatcataaaagatacaaatattaactgtttgatccgtaataacattgctagtcgatagcaatttgttaataagatgcgctgggctcaatgtct
taataagaagtgtaagaggactatctccgaatttgtttgtttattaacatccgttgatggaagtaaaagatctataatgtctacattcttgact
gtttttagagcatacaatatggagaggtgtatttccatcatgatctggttttgagggactaattcctagtttcatcatccatgagattgtagaagc
ttttggattgtctgacataagatgtctatgaatatgattttttgccaaatttatccactatcctggcttcgaatccgatggacattatttttttaaac
actctttctgaaggatctgtacacgccaacaacggaccacatccttcttcatcaaccgagttgttaatcttggctccatactgtaccaataaat
ttattctctctatgacttcatcatctgttcccgagagataatatagaggtgtttattatgtttatcacacgcgtttggatctgcgccgtgcgtcag
cagcatcgcgactattctattattattaattttagaagctatatgcaatggataaatttccatcatcatccgtctcatttggagagtatcctctatg
aagaagttcttcgacaaatcgttcatctcagtcctttaattccacaatacgcatgtagaatgtgataattatttccagaaggttcgatagcttgta
gcatattcctaaatacatctaaattttactattatatttggcataaagagatagataatactcggccgacataatgttgtccattgtagtataa
aaattaatatttctatttctatttctgtatatttgcaacaatttactctctataacaaatatcataacttagttcttttatgtcaagaaggcactgg
tttagttcatctataaatgtcacgccataactaccacgcatgccatactcagaattatgataaagatatttatccttggggtgtaggtaatggg
gattaatctttgttggatcagtctctaagttaacacatgtcacacatgatccatttatagttatatcacacgatgatgatttatgaattgattccg
gaagatcgctatcgtattttgtggttccacaattcatttccatacatgttattgtcacactaatattatgatgaactttatctagccgctgagtgg
taaacaacagaacagatagtttattatctttaccaacaccctcagccgctgccacaaatctctgatccgtatccatgatggtcatgtttatttct
agtccgtatccagtcaacactatgttagcatttctgtcgatatagctttcactcatatgacactcaccaataatagtagaattaatgtcgtaatt
tacaccaatagtgagttcggcggcaaagtaccaataccggtaatcttgtcgaggaggacatatagtattcttgtattctactgaatacccga
gagatgcgatacaaaagagtaagactaatttgtaaaccatcttactcaaaatatgtaacaatagtacgatgcaatgagtaagacaatagg
aaatctatcttatatacacataattattctatcaatttttaccaattagttagtgtaatgttaacaaaaatgtgggagaatctaattagttttctttt
acacaattgacgtacatgagtctgagttccttgttttttgctaattatttcatccaatttattattcttgactatatcgagatctttttgtataggagtc
agacttgtattcaacatgctttttctataatcattttagctatttcggcatcatccaatagtacattttccagattagcagaatagatattaatgtc
gtatttgaacagagcctgtaacatctcaatgtctttattatctatagccaatttaatgtccggaatgaagagaagggaattattggtgtttgtc
gacgtcatatagtcgagcaagagaatcatcatatccacgtgtccatttttttatagtggtgtgaatacaactaaggagaatagccagatcaaa
agtagatggtatctctgaaagaaagtaggaaacaatacttacatcattaagcatgacggcatgataaaatgaagttttccatccagtttttcc
catagaacatcagtctccaattttttcttaacaaacagttttaccgtttgcatgttaccactatcaaccgcataatacaatgcggtgtttcccttgt
catcaaattgtgaatcatccagtccactgaatagcaaaatctttactattttggtatcttccaatgtggctgcctgatgtaatggaaattcattc

FIG. 12G tctagaagatttttcaatgctccagcgttcaacaacgtacatactagacgcacgttattatcagctattgcataatacaaggcactatgtccat
ggacatccgccttaaatgcatctttgctagagagaaagcttttcagctgcttagacttccaagtattaattcgtgacagatccatgtctgaaac
gagacgctaattagtgtatatttttcattttttataattttgtcatattgcaccagaattaataatatctctaatagatctgattagtagatacat
ggctatcgcaaaacaacatatacacatttaataaaaataatatttattaagaaaattcagatttcacgtacccatcaatataaataaaataa
tgattccttacaccgtacccatattaaggagattccaccttacccataaacaatatataatccagtaatatcatgtctgatgatgaacacaaat
ggtgtattaaattccagttttcaggagatgatctcgccgtagctaccatgatagtagatgcctctgctacagttccttgttcgtcgacatctatc
tttgcattctgaaacattttataaatatataatgggtccctagtcatatgtttaaacaacgcattatctggattaaacatactaggagccatcat
ttcggctatcgacttaatatccctcttattttcgatagaaaatttagggagtttaagattgtacactttattccctaattgaaacgaccaatagtc
taattttgcagccgtaatagaatctgtgaaatgggtcatattatcacctattgccaggtacatactaatattagcatccttatacggaaggcgt
accatatcatattcttcgtcatcgattgtgattgtatttccttgcaatttagtaactacgttcatcatgggaaccgttttcgtaccgtacttattagt
aaaactagcattgcgtgtttagtgatatcaaacggatattgccatatacctttaaaatatatagtattaatgattgcccatagagtattattgt
cgagcatattagaatctactacattagacataccggatctacgttctactatagaattaattttattaaccgcatctcgtctaaagtttaatcta
tataggccgaatctatgatattgttgataatacgacggtttaatgcacacagtattatctacgaaactttgataagttagatcagtgtacgtat
atttagatgttttcagcttagctaatcctgatattaattctgtaaatgctggacccagatctcttttttctcaaatccatagtcttcaataattctatt
ctagtattacctgatgcaggcaatagcgacataaacatagaaaacgaataaccaaacggtgagaagacaatattatcatcttgaatattttt
atacgctactataccggcattggtaaatccttgcagacgataggtagacactgaacacgttaacgatagtatcaataacgcaatcatgattt
tatggtattaataattaaccttattttatgttcggtataaaaattattgatgtctacacatccttttgtaattgacatctatatatccttttgtataa
tcaactctaatcactttaactttacagttttccctaccagtttatccctatattcaacatatctatccatatgcatcttaacactctctgccaaga
tagcttcaaagtgaggatagtcaaaaagataaatatatagagcataatcattctcgtatactctgccctttattacatcacccgcattgggca
acgaataacaaaatgcaagcatcttgttaacgggctcgtaaattgggataaaaattatgttttttatatctattttattcaagagaatattcagg
aatttcttttttccggttgtatctcatcgcagtatatatcatttgtacattgtttcatattttttaatagtctacaccttttagtaggactagtatcgta
caattcatagctgtattttgaattccaatcacgcataaaaatatcttccaattgttgacgaagacctaatccatcatccggtgtaatattaata
gatgctccacatgtatccgtaaagtaatttcctgtccaatttgaggtacctatatacgccgttttatcggttaccatatatttggcatggtttacc
ctagaatacggaatggggaggatcagcatctggtacaataaatagctttacttctatatttatgttttttagattttagcatagcgatagatcttaa
aaagtttctcatgataaacgaagatcgttgccagcaactaatcaatagcttaacggatacttgtctgtctatagcggctcttcttaattcatctt
ctatataaggccaaaacaaaatattgcctgccttcgaataaataataggggataaagttcataacagatacataaacgaatttactcgcattt
ctaatacatgacaataaagcggttaaatcattggttctttccatagtacatagttgttgcggtgcagaagcaataaatacagagtgtggaac
accacttacgttaatactaagaggatgatctgtattataatacgacggataaaagtttttccaattatatggtagattgttaactccaagatac
cagtatacctcaaaaatttgagtgagatccgctgccaagttcctattattgaagatcgcaatacccaattctttgacctgagttagtgatctcc
aatccatgttagcgcttcctaaataaatatgtgtattatcagatatccaaaattttgtatgaagaactcctcctaggatatttgtaatatctatg
tatcgtacttcaactccggccatttgtagtctttcaacatcctttaatggtttgttagatttattgacggctactctaactcttactcctcttttggg
taattgtacaatctcgtttaatattatcgtgccgaaattcgtacccacttcatccgatasaactccaataaaaagatgatatatctagtgtttttgt
ggtattggatagaatttccctccacatgttaaatgtagacaaatatactttatcaaattgcatacctataggaatagtctctgtaatcactgcg
attgtattatccggattcatttatttgttaaaaaataatcctatatcacttcactctattaaaaatccaagtttctatttctttcatgactgatttt
taacttcatccgtttccttatgaagatgatgtttggcaccttcataaattttttatttctctattacaatttgcatgttgcatgaaataatatgcacct
aaaacatcgctaatctcattgtttgttccctggagtatgagagtcggggggtgttaatcttgggaattattttttctaaccttgttggtagccttca
agacctgactagcaaatccagccttaattttttcatgattgattaatgggtcgtattggtatttataaactttatccatatctctagatactgattc
tggacatagctttccgactggcgcatttggtgtgatggttcccataagtttggcagctagcagattcagttttgaaacagcatctgcattaact
agaggagacattagaatcattgctgtaaacaagtttggattatcgtaagaggctagtatagaaattgttgctcccatggaatgCCCAATA
AGAAGACTGGAACTCCTAAATAAGTAGATTTAATAGTTACCACGTGCTGTACCACATCTCTAACATACGTACC
AAAGTCATCAATCATCATTTTTTCACCATTACTTCTTCCATGTCCAATATGATCATGTGAGAATACTAAAATTCC
TAACGATGATATGTTTTCAGCTAGTTCGTCATAACGTCCAGAATGTTTACCAGCTCCATGACTTATGAATACTA
ATGCCTTAGGATATGTAATAGGTTTCCAATATatgtaatcattgtccagattgaacatacagtttgcactcatgattcacgttatat
aactatcaatattaacagttcgtttgatgatcatattattttttatgttttattgataattgtaaaaacatacaattaaatcaatatagaggaagg

FIG. 12H agacggctactgtctttgtgagatagtcatggcgactaaattagattatgaggatgctgtttttactttgtggatgatgataaaatatgtagt
cgcgactccatcatcgatctaatagatgaatatattacgtggagaaatcatgttatagtgtttaacaaagatattaccagttgtggaagactg
tacaaggaattgatgaagttcgatgatgtcgctatacggtactatggtattgataaaattaatgagattgtcgaagctatgagcgaaggaga
ccactacatcaattttacaaaagtccatgatcaggaaagtctattcgctaccataggaatatgtgctaaaatcactgaacattgggggataca
aaaagatttcagaatctagattccaatcattgggaaacattacagatctgatgaccgacgataatataaacatcttgatacttttctagaaa
aaaaattgaattgatgatatagggggtcttcataacgcataattattacgttagcattctatatccgtgttaaaaaaaattatcctatcatgtatt
tgagagtttatatgtagcaaacatgatagctgtgatgccaataagctttagatattcacgcgtgctagtgttagggatggtattatctggtgg
tgaaatgtccgttatataatctacaaaacaatcatcgcatatagtatgcgatagtagagtaaacatttttatagtttttactggattcatacatc
gtctacccaatttggttataaatgaaattgtcgccaatcttacacccaacccttgttatccattagtatagtattaacttcgttatttatgtcata
aactgtaaatgattttgtagatgccatatcatacatgatattcatgtccctattataatcattactaactttatcacaatatatgttgataatatc
tatatatgatctagtctttgtgggcaactgtctatacaagtcgtctaaacgttgtttactcatatagtatcgaacagccatcattacatggtccc
gttccgttgatagataatcgagtatgttagtggacttgtcaaatctatataccatattttctggaagtggatatacatagtcgtgatcaacatta
ttgctagcctcatcttctatatcatgtactataccattatctatatcatctacataatctacgatattattacacataaacatcgacaacatacta
ttgtttattatctaagtcctgttgatccaaacccttgatctcctctatttgtactatctagagattgtacttcttccagttctggataatatatacgtt
gatagattagctgagctattctatctccagtatttacattaaacgtacattttccattattaataagaatgactcctatgtttcccctataatcttc
gtctattacaccacctcctatatcaatgcctttttagtgacagaccagacctaggagctattctaccatagcaaatcttaggcatggacatact
aatatctgtcttaattaactgtctttctcctggagggatagtataatcgtaagcgctatacaaatcatatccggcagcacccggcgattgccta
gtaggagatttagctctgttagtttccttaacaaatctaactggtgagttaatattcatgttgaacataaaactaatattttatttcaaaattattt
accatcccatatattccatgaataagtgtgatgattgtacacttctatagtatctatatacgattcacgataaaatcctcctatcaatagcagtt
tattatccactatgatcaattctggattatccctcggataaataggatcatctatcagagtccatgtattgctggattcacaataaaattccgc
atttctaccaaccaagaataaccttctaccgaacactaacgcgcatgatttataatgaggataataagtggatggtccaaactgccactgat
catgattgggtagcaaatattctgtagttgtatcagtttcagaatgtcctcccattacgtatataacattgtttatagatgccactgctggattac
atctaggtttcagaagactcggcatattaacccaagcagcatccccgtggaaccaacgctcaacagatgtgggatttggtagacctcctact
acgtataatttattgttagcgggtatcccgctagcatacagtctggggctattcatcggaggaattggaatccaattgtttgatatataatttac
agctatagcattgttatgtatttcattgttcatccatccaccgatgagatatactacttctccaacatgagtacttgtacacatatggaatatatc
tataatttgatccatgttcataggatactctatgaatggatacttgtatgatttgcgtggttgtttatcacaatgaaatattttggtacagtctag
tatccattttacattatttatacctctgggagaaagataatttgacctgattacattttgataaggagtagcagatttcctaatttatttcttcgc
tttatataccacttaatgacaaaatcaactacataatcctcatctggaacatttagttcatcgctttctagaataagtttcatagatagataatc
aaaattgtctatgatgtcatcttccagttccaaaaagtgtttggcaataaagtttttagtatgacataagagattggatagtccgtattctatac
ccatcatgtaacactcgacacaatattcctttctaaaatctcgtaagataaagtttatacaagtgtagatgataaattctacagaggttaatat
agaagcacgtaataaattgacgacgttatgactatctatatataccttttccagtatacgagtaaataactatagaagtaaactgtgaatgtc
aaggtctagacaaaccctcgtaactggatctttattttttcgtgtatttttgacgtaaatgtgtgcgaaagtaaggagataacttttttcaatatcg
tagaattgactattatattgccacctatagcatcaataattgttttgaatttcttagtcatagacaatgctaatatattcttacagtacacagtat
taacaaatatcggcatttatgtttctttaaaagtcaacatctagagaaaaatgattatctttttgagacataactcccattttttggtattcaccc
acacgtttttcgaaaaaattagtttttccttccaatgatatatttccatgaaatcaaacggattggtaacattataaattttttttaaatcccaatt
cagaaatcaatctatccgcgacgaattctatatatgttttcatcatttcacaattcattcctataagtttaactggaagagccgcagtaagaaa
ttcttgttcaatggatactgcatctgttataatagatctaacggtttcttcactcggtggatacaataaatgtttaaacatcaaacatgcgaagt
cgcagtgtagaccctcgtctctactaattagttcgttggaaaacgtgagtccgggcattaggccacgcttttttaagccaaaatatggaagcg
aatgatccggaaaagaagattccttctactgcagcaaaggcaataagtctctctccataaccggcgctgtcatgtatccacttttgagccca
atcggccttcttttttacacaaggcatcgtttctatggcattaaagagatagttttttttcattactatctttaacataagtatcgatcaaaagact
atacatttccgaatgaatgtttcaatggccatctgaaatccgtagaaacatctagcctcggtaatctgtacttctgtacaaaatcgttccgcc
aaattttcattcactattccgtcactggctgcaaaaaacgccaatacatgtttttataaaatattttcgtctggtgttagtttattccaatcattga
tatctttagatatatctacttcttccactgtccaaaatgatgcctctgcctttttatacatgttccagatgtcataatattggattgggaaaataa
caaatctatttggatttggtgcaaggatgggttccataactaaattaacaatatcaataaatttttttttcagttatctatatgcctgtacttggat

FIG. 12I tttttgtacatcgatatcgccgcaatcactacaataattacaagtattattgatagcattgttattagtactatcataattaaattatcgacattc atgggtgctgaataatcgttattatcatcattatcattttgtaattgtgacatcatactaaataaatcgtttgcgagattgttgtgggaagcggg catggaggatgcattatcattattatttaacgccttccatttggattcacaaatgttacgcacattcaacattttatggaaactataattttgtga aaacagataacaagaaaactcgttatcgttcaaatttttaacgatagtaaaccgattaaacgtcgagctaatttctaacgctagcgactctgt tggatatgggtttccagatatatatcttttcagttcccctacgtatctataatcatctgtaggaaatggaagatatttccatttatctactgttcct aatatcatatgtggtggtgtagtagaaccattaagcgcgaaagatgttatttcgcatcgtattttaacttcgcaataatttctggttagataacg cactctaccagtcaagtcaatgatattagcctttacagatatattcatagtagtcgtaacgatgactccatcttttagatgcgatactcctttgt atgtaccagaatcttcgtacctcaaactcgatatatttaaacaagttaatgagatattaacgcgtttttatgaatgatgatatataaccagaagt tttatcctcggtggctagcgctataaccttatcattataataccaactagtgtgattaatatgtgacacgttagtgtgggtacaaatatgtacat tatcgtctacgtcgtattcgatacatccgcatacagccaacaaatataaaatgacaaatactctaacgccgttcgtacccatcttgatgcggt ttaataaatgtttgatttcaatttattgtaaaaaaagattcggttttatactgttcgatattctcattgcttatatttcatctatcatctccacaca gtcaaatccgtggttagcatgcacctcatcaaccggtaaaagactatcggactcttctatcattataactctagaatatttaatttggtcattat taatcaagtcaattatcttattttaacaaacgtgagtattttactcatttttataaaaacttttagaaatatacagactctatcgtgtgtctata tcttctttttatatccaatgtatttatgtctgatttttcttcatttatcatatataatggtccaaattctacacgtgcttcggattcatccagatcatt aaggttcttataattgtaacatccttctcttccctcttctacatcttccttcttattcttattcttagcgtcacagaatctaccacagcaggatccca tgacgagcgtcatattaaactaattcattttcaattataatataTGGTAATGACCATTAAAATAAAAATATTCTTCATAACCGG

TAAGAAAGTGAAAAGTTCACATTGAAACTATGTCAGTAGTATACATCATGAAATGAGATGAAATGATGATAT

ATATACTctattttggtggaggattatatgatataattcgtggataatcatttttaagacacatttctttattcgtaaatcttttcacgttaaatg agtgtccatattttgcaatttcttcatatgatggcggtgtacgtggacgaggctgctcctgttcttgttgtagtcgccgactgtcgtgtttgcgttt agatccctccattatcgcgattgcgtagatggagtactattatataccttgtaattaaatttttttattaattaaacgtataaaaacgttccgtat ctgtatttaagagccagatttcgtctaatagaacaaatagctacagtaaaaataactagaataattgctacacccactagaaaccacggat cgtaatacggcaatcggttttcgataataggtggaacgtatattttatttaaggacttaacaattgtctgtaaaccacaatttgcttccgcgga tcctgtattaactatctgtaaaagcatatgttgaccgggcggagccgaacattctccgatatctaatttctgtatatctataatattattaacct ccgcatacgcattacagttcttttctagcttggataccgcactaggtacatcgtctagatctattcctatttcttcagcgatagctcttctatcctt ttccggaagcaatgaaatcacttcaataaatgattcaaccatgagtgtgaaactaagtcgagaattactcatgcatttgttagttattcggag cgcgcaattttaaactgtcctataacctctcctatatgaatagcacaagtgacattagtagggatagaatgttgagctaattttgtaaataa ctatctataaaaagattatacaaagtttaaactctttagtttccgccatttatccagtctgagaaaatgtctctcataataaatttttccaaga aactaattgggtgaagaatggaaacctttaatctatatttatcacagtctgtcttggtacacatgatgaattcttctaatgctgtactaaattcg atatcttttcgatttctggatatgttttaataaagtatgaacaaagaaatggaaatcgtaataccagttatgtttaactttgaaattgtttttta ttttcttgttaatgattccagccacttgggaaaagtcaaagtcgtttaatgccgatttaatacgttcattaaaaacaaacttttatcctttagat gaattattattggttcattggaatcaaaaagtaagatattatcgggtttaagatctgcgtgtaaaaagttgtcgcagcatggtagttcgtaaat tttaatgtataacagagccatctgtaaaaagataaactttatgtattgtaccaaagatttaaatcctaatttgatagctaactcggtatctactt tatctgcagaatacagtgctaggggaaaaattataatatttcctctttcgtattcgtagttagttctcttttcatgttcgaaaaagtgaaacatg cggttaaaatagtttataacattaatattactgttaataactgccgggtaaaagtgggatagtaatttcacgaatttgatactgtcctttctctc gttaaacgcctttaaaaaaactttagaagaatatctcaatgagagttcctgaccatccatagtttgtatcaataatagcaacatatgaagaa cccgtttatacagagtatgtaaaaatgttaatttatagtttaatcccatggcccacgcacacacgattaatttttttttcatctcccttttagattgtt gtatagaaatttgggtactgtgaactccgccgtagtttccatgggactatataattttgtggcctcgaatacaaattttactacatagttatcta tcttaaagactataccatatcctcctgtagatatgtgataaaaatcgtcgtttataggataaaatcgtttatccttttgttggaaaaaggatga attaatgtaatcattctcttctatctttagtagtgtttccctattaaaattcttaaaataatttaacaatctaactgacggagcccaatttggtgt aaatctaattgggacattatattgttaaaatacaaacagtctcctaatataacagtatctgataatctatggggagacatccattgatattca ggggatgaatcattggcaacacccatttattgtacaaaaagccccaatttacaaacgaaagtccaggtttgatagagacaaactattaact attttgtctctgttttttaaatttctttagtaatgaaattattcacaatatcagtatcttctttatctaccagagatttactaacttgataaccttggct gtctcattcaataggggtagtaatatttgtatgtgtgatattgatatcttttttgaattgtttctttttagaagtgattctttgatggtgccagcatacga attacaataatgcagaaactcggttaacatgcaggaattatagtaagccaattccaattgttgcctgtattgtattagagtattaatatgcgca

FIG. 12J atggtgtccttgcgtttctctgatagaatgcgagcagcgattttggcgttatcatttgacgatatttctggaatgacgaatcctgtttctactaac
ttttggtaggacaaagtgaaacaatcaagaagatagcttctcctcctatttgtggaagaaattgaactcctctagatgatctactgacgata
gtatctccttgacagatattggaccgaattacagaagtacctggaatgtaaagccctgaaacccctcatttttttaagcagattgttgccgta
aatcctgcactgtgaccaagatagagagctcctttggtgaatccatctctatgtttcagtttaaccaagaaacagtcagctggtctaaaatttc
catctctatctaatacagcatctaacttgatgtcaggaactatgaccggtttaatgttatatgtaacattgagtaaatccttaagttcataatca
tcactgtcatcagttatgtacgatccaaacaatgtttctaccggcatagtggatacgaagatgctatccatcagaatgtttccctgattagtatt
ttctatatagctattcttctttaaacgattttccaaatcagtaactatgttcatttttttaggagtaggacgcctagccagtatggaagaggattt
tctagatcctctcttcaacatctttgatctcaatggaatgcaaaaccccatagtgaaacaaccaacgataaaaataatattgtttttcacttttt
ataattttaccatctgactcatggattcattaatatctttataagagctactaacgtataattctttataactgaactgagatatatacaccgga
tctatggtttccataattgagtaaatgaatgctcggcaataactaatggcaaatgtatagaacaacgaaattatactagagttgttaaagtta
atattttctatgagctgttccaataaattatttgttgtgactgcgttcaagtcataaatcatcttgatactatccagtaaacagtctttaagttctg
gaatattatcatcccattgtaaagcccctaattcgactatcgaatatcctgctctgatagcagtttcaatatcgacggacgtcaatactgtaat
aaaggtggtagtattgtcatcatcgtgataaactactggaatatggtcgttagtaggtacggtaactttacacaacgcgatatataactttcc
ttttgtaccattttaacgtagttgggacgtcctgcagggtattgttttgaagaaatgatatcgagaacagatttgatacgatatttgttggattc
ctgattatttactataatataatctagacagatagatgattcgataaatagaaaaggtatatcgttggtaggataatacatccccattccagt
attctcggatactctattaatgacactagttaagaacatgtcttctattctagaaaacgaaaacatcctacatggactcattaaaacttctaac
gctcctgattgtgtctcgaatgcctcgtacaaggatttcaaggatgccatagattctttgaccaacgatttagaattgcgtttagcatctgatttt
tttattaaatcgaatggtcggctctctggtttgctaccccaatgataacaatagtcttgtaaagataaaccgcaagaaaatttatacgcatcc
atccaaataaccctagcaccatcggatgatattaatgtattattatagattttccatccacagttattgggccagtatactgttagcaacggta
tatcgaatagattactcatgtaacctactagaatgatagttcgtgtactagtcataatatctttaatccaatcaagaaatataaaattagatc
ttttacactgttaaagttaacaaaggtattacccggatacgtggatatcatatatggcattggtccattatcagtaatagctccataaactgat
acggcgatggtttttatatgtgtttgatctaacgaggaagaaattcgcgcccacaattcatctctagatatgtatttaatatcaaacggtaaca
catcaatttcgggacgcgtatatgtttctaaattttaatccaaatataatgatgacctatatgccctattatcatactgtcaactatagtacac
ctagagaacttacgatacatctgtttcctgtaatcgttaaattttacaaatctataacatgctaaacctttgacgacaaccattcattaatttct
gatatggaatctgtattctcgataccgtattgttctaaagccagtgctatatctccctgttcgtgggaacgctttcgtataatatcgatcaacgg
ataatctgaagtttttggagaataatatgactcatgatctatttcgtccataaacaatctagacataggaattggaggcgatgatcttaatttt
gtgcaatgagtcgtcaatcctataacttctaatcttgtaatattcatcatcgacataatactatctatgttatcatcgtatattagtataccatga
ccttcttcatttcgtgccaaaatgatatacagtcttaaatagttacgcaatatctcaatagtttcataattgttagctgttttcatcaagatttgta
ccctgtttaacatgatggcgttctattttctattttttaaatttttaacgatttactgtggctagatacccaatctctctcaaatattttttttagcctc
gcttacaagctgtttatctatactattaaaaactgacgaatccgtgattttggtaatgggttccgtcgaaatttgccgaagtgatatgaacatatt
cgtcgtcgactatcaacaattttgtattattctgaatagtgaaaaccttcacagatagatcattttgaacacacaacgcgtctagacttctggc
ggttgccatagaatatacgtcgttcttatcccaattaccaactagaagtctgatcttaactcctctattaatggctgcttctataatggagttgt
aaatgtcgggccaatagtagctattaccgtcgacacgtgtagtgggaactatggccaaatgttcaatatctatactagtcttagctgacctga
gtttatcaataactacatcggtatctagatctctagaatatcccaataggtgttccggagaatcagtaaagaacactccacctataggattct
taatatgatacgcagtgctaactggcagacaacaagccgcagagcatataattcaaccatgaattttttgcgctattaaaggctttaaaagta
tcaaatcttctacgaagatctgtggccagcggggggataatcagaatatacacctaacgttttaatcgtatgtatagatcctccagtaaatgac
gcgtttcctacataacatctttcatcatctgacacccaaaaacaaccgagtagtagtcccacattatttttttttatctatattaacggttataaa
atttatatccgggcagtgactttgtagctctcccagatttctttcccctcgttcatctagcaaaactattattttaatcccttttttcagatgcctcttt
tagtttatcaaaaataagcgctcccctagtcgtactcagaggattacaacaaaaagatgctatgtatatatatttcttagctagagtgataatt
tcgttaaaacattcaaatgttgttaaatgatcggatctaaaatccatattttctggtagtgtttctaccagcctacattttgctcccgcaggtacc
gatgcaaatggccacatttagttaacataaaaacttatacatcctgttctatcaacgattctagaatatcatcggctatatcgctaaaattttc
atcaaagtcgacatcacaacctaactcagtcaatatattaagaagttccatgatgtcatcttcgtttatttctatatccgtatccattgtagattg
ttgaccgattatcgagtttaaatcattactaatactcaatccttcagaatacaatctgtgtttcattgtaaatttataggcggtgtatttaagttg
gtagattttcaattatgtatcaatatagcaacagtagttcttgctcctccttgattctagcatcctcttcattattttcttctacgtacataaacatg

FIG. 12K tccaatacgttagacaacacaccgacgatggcggccgccacagacacgaatatgactaaaccgatgaccatttaaaaaccccctctctagc
tttcacttaaactgtatcgattattcttttagaacatgtataatataaaaacattattctatttcgaatttaggcttccaaaaatttttcatccgta
aaccgataataatatatatagacttgttaatagtcggaataaatagattaatgcttaaactatcatcatctccacgattagagatacaatattt
acattcttttttgctgtttcgaaactttatcaatacacgttaatacaaacccaggaaggagatattgaaactgaggctgttgaaaatgaaacgg
tgaatacaataattcagataatgtaaaatcatgattccgtattctgatgatattagaactgctaatggatgtcgatggtatgtatctaggagta
tctattttaacaaagcatcgatttgctaatatacaattatccttttgattaattgttattttattcatattcttaaaaggtttcatatttatcaattctt
ctacattaaaaatttccatttttaatttatgtagccccgcaatactcctcattacgtttcattttttgtctataatatccattttgttcatctcggtac
atagattatccaattgagaagcgcatttagtagttttgtacattttaagtttattgacaaatcgtcgaaaactagttatagttaacattttattatt
tgataccctgatattaatacccctgccgttactattatttataactgatgtaatccacgtaacattagaattaattatcgatagtaatgcatcga
cgcttccaaaattgtctattataaactcaccgataattttttttattgcatgttttcatattcattaggattatcaaatctttaatcttattacgattgt
atgcgttgatattgcaagacgtcattctaaaagacggaggatctccatcaaatgccaaacaatcacgtacaaagtacatggaaataggtttt
gttctattgcgcatcatagatttatatagaacacccgtagaaatactaatttgtttactctataaaatactaatgcatctatttcatcgtttttgta
taacgtctttccaagtgtcaaattccaaatttttttcattgatagtaccaaattcttctatctctttaactacttgcatagataggtaattacagtg
atgcctacatgccgttttttgaaactgaatagatgcgtctagaagcgatgctacgctagtcacaatcaccactttcatatttagaatatatgta
tgtaaaaatatagtagaatttcattttgtttttttctatgctataaatgaattctcattttgcatctgctcatactccgttttatatcaataccaaag
aaggaagatatttggttctaaaagccgttaaagtatgcgatgttagaactgtagaatgtgaaggaagtaaagcttcctgcgtactcaaagt
agataaaccctcatcacccgcgtgtgagagaagaccttcgtccccttccagatgcgagagaatgaataacccaggaaaacaagttccgttt
atgaggacggacatgctacaaaatatgttcgcggctaatcgcgataatgtagcttctagacttttgtcctaaaatactattatatcctttttcgat
attaataaatccgtgtcgtccaggttttttatctctttcagtatgtgaatagataggtattttatctctattcatcatcgaatttaagagatccgat
aaacattgtttgtattctccagatgtcagcatctgatacaacaatatatgtgcacataaacctctggcacttatttcatgtaccttcccccttatca
ctaaggagaatagtatttgagaaatatgtatacatgatattatcatgaattagatatacagaatttgtaacactctcgaaatcacacgatgtg
tcggcgttaagatctaatatatcactcgataacacattttcatctagatacactagacatttttaaagctaaaatagtctttagtagtgacagt
aactatgcgattattttcatcgatgatacatttcatcggcatattattacgcttaccatcaaagactataccatgtgtatatctaacgtattctag
catggttgccatacgcgcattaaacttttcaggatctttggatagatcttccaatctatctatttgagaaaacatttttatcatgttcaatagttg
aaacgtcggatccactatatagatattatctataaagatttttaggaactacgttcatggtatcctggcgaatattaaaactatcaatgatatg
attatcgtttttcatcttttatcaccatatagtttctaagatatggggatttttacttaatataatattatttcccgtgataaattttattagaaaggcca
aatctataagaaaagtcctagaattagtctgaagaatatctatatcgccgtatagtatatttggattaattagatatagagaatatgatccgt
aacatatacaacttttattatggcgtctaagatattcttccatcaacttattaacattttttgactagggaagatacattatgacgtcccattactt
ttgccttgtctattactgcgacgttcatagaatttagcatatctcttgccaattcttccattgatgttacattataagaaattttagatgaaattac
atttggagctttaatagtaagaactcctaatatgtccgtgtatgtggtcactaatacagattgtagttctataatcgtaaataatttacctatatt
atatgtttgagtctgtttagaaaagtagctaagtatacgatcttttatttctgatgcagatgtattaacatcggaaaaaaatctttttttattcttt
tttactaaagatacaaatatgtctttgttaaaaacagttattttttgaatatttctagcttgtaattttaacatatgatattcgttcacactaggta
ctctgcctaaataggtttctataatctttaatgtaatattaggaaaagtattctgatcaggattcctattcattttgaggatttaaaactctgatt
attgtctaatatggtctctacgcaaacttttcacagagcgatagagttttgataactcgttttcttaagaaatataaaactactgtctccag
agctcgctctatcttttatttatctaattcgatacaaactcctgatactggttcagaaagtaattcattaattttcagtcctttatagaagatattt
aatatagataatacaaaatcttcagttttgatatcgatctgattgatcctagaactagatatattaataacgtgctcattaggcagtttatggc
agcttgataattagatatagtatattccagttcatatttattagataccgcattgcccagattttgatattctatgaattcctctgaaaataaatc
caaaataactagacattctattttttgtggattagtgtactctcttccctctatcatgttcactactggtgtccacgatgataaatatctagaggg
aatataatatagtccataggatgccaatctagcaatgtcgaataactgtaatttattcttcgctcttcattatgaattgattcttgaggtataaa
cctaacacaaattatattattagacttttcgtatgtaatgtctttcatgttataagtttttaatcctggaatagaatctattttaatgaggcttttaa
acgcagagttctccaacgagtcaaagcataatactctgttgttttttcttatatacgatgttacgattttcttctttgaatggaataggttttttgaat
tagtttataattacaacataatagataaggaagtgtgcaaatagtacgcggaaaaaacataatagctcccctgttttcatccatggttttaag
taaatgatcactggcttctttagtcaatggatattcgaacattaaccgtttcatcatcattggacagaatccatattttttaatgtaaagagtga
tcaaatcattgtgtttattgtaccatcttgttgtaaatgtgtattcggttatcggatctgctcctttttctattaaagtatcgatgtcgatctcgtcta

FIG. 12L agaattcaactatatcgacatatttcatttgtatacacataaccattactaacgtagaatgtataggaagagatgtaacgggaacagggttt
gttgattcgcaaactattctaatacataattcttctgttaatacgtcttgcacgtaatctattatagatgccaagatatctatataattattttgta
agatgatgttaactatgtgatctatataagtagtgtaataattcatgtattttgatatatgttccaactctgtctttgtgatgtctagtttcgtaat
atctatagcatcctcaaaaaatatattcgcatatattcccaagtcttcagttctatcttctaaaaaatcttcaacgtatggaatataataatcta
ttttacctcttctgatatcattaatgatatagttttttgacactatcttctgtcaattgattcttattcactatatctaagaaacggatagcgtcccta
ggacgaactactgccattaatatctctattatagcttctggacataattcatctattataccagaattaatgggaactattccgtatctatctaa
catagttttaagaaagtcagaatctaagacttgatgttcatatattggttcatacatgaaatgatctctattgatgatagtgactatttcattctc
tgaaaattggtaactcattctatatatgctttccttgttgatgaaggatagaatatactcaatagaatttgtaccaacaaactgttctcttatga
atcgtatatcatcatctgaaataatcatgtaaggcatacatttaacaattagagacttgtctcctgttatcaatatactattcttgtgataattta
tgtgtgaggcaaatttgtccacgttctttaattttgttatagtagatatcaaatccaatggagctacagttcttggcttaaacagatatagttttt
ctggaacgaattctacaacattattataaaggactttgggtagataagtgggatgaaatcctattttaattaatgcgatagccttgtcctcgtg
cagatatccaaacgcttttgtgatagtatggcattcattgtctagaaacgctctacgaatatctgtgacagatatcatctttagagaatatact
agtcgcgttaatagtactacaatttgtatttttttaatctatctcaataaaaaaattaatatgtatgattcaatgtataactaaactactaactgtt
attgataactagaatcagaatctaatgatgacgtaaccaagaagtttatctactgccaatttagctgcattattttttagcatctcgtttagatttt
ccatctgccttatcgaatactcttccgtcgatatctacacaggcataaaatgtaggagagttactaggccccactgattcaatacgaaaaga
ccaatctctcttagttatttggcagtactcattaataatggtgacagggttagcatctttccaatcaataattttttttagccggaataacatcatc
aaaagacttatgatcctctctcattgattttttcgcgggatacatcatctattatggcgtcagccataacatcagcatccggcttatccgcctccg
ttgtcataaaccaacgaggaggaatatcgtcggagctgtacaccatagcactacgttgaagatcgtacagagctttattaacttctcgcttct
ccatattaagttgtctagttagttgtgcagcagtagctccttcgattccaatgttttttaatagccgcacacacaatctctgcgtcagaacgctcg
tcaatatagatcttagacatttttagagagaactaacacaaccagcaataaaactaatttattttatcatttttttattcatcatcctctggtggt
tcgtcgtttctatcgaatgtggatctgattaacccgtcatctataggtgatgctggttctggagattctggaggagatgggattattatctggaag
aatctctgttatttccttgttttcatgtatcgattgcgttgtaacattaagattgcgaaatgctctaaatttgggaggcttaaagtgttgtttgcaa
tctctacacgcatgtctaactagtggaggttcgtcagcggctctagtttgaatcatcatcggcgtagtattcctacttttacagttaggacacg
gtgtattgtatttctcgtcgagaacgttaaaataatcgttgtaactcacatcctttattttatctatattgtattctactcctttcttaatgcatttttat
accgaataagagatagcgaaggaattctttttcggtgccgctagtacccttaatcatatcacatagtgttttatattccaaatttgtggcaata
gacggtttatttctatacgatagtttgtttctggaatcctttgagtattctataccaatattattctttgattcgaatttagtttcttcgatattagatt
ttgtattacctatattcttgatgtagtacttttgatgattttttccatggcccattcttattaagtcttccaagttggcatcatccacatattgtgatagt
aattctcggatatcagtagcggctaccgccattgatgtttgttcattggatgagtaactactaatgtatacattttccatttataacacttatgta
ttaactttgttcatttatattttttcattattatgttgatattaacaaaagtgaatatatatatatgttaataattgtattgtggttatacggctacaa
ttttataatgagtgaaagtcagtgtccgatgatcaatgacgatagctttactctgaaaagaaagtatcaaatcgatagtgcggagtcaacaa
taaaaatggataagaagaggataaagtttcagaatagagccaaaatggtaaaagaaataaatcagacaataagagcagcacaaactca
ttacgagacattgaaactaggatacataaaatttaagagaatgattaggactactactctagaagatatagcaccatctattccaaataatc
agaaaacttataaactattctcggacatttcagccatcggcaaagcatcacagaatccgagtaagatggtatatgctctgctgctttacatgt
ttcccaatttgtttggagatgatcatagattcattcgttatagaatgcatccaatgagtaaaatcaaacacaagatcttctctcctttcaaactt
aatcttattagaatattagtggaagaaagattctataataatgaatgcagatctaataaatggaaataattggaacacaagttgataaaat
gttgatagctgaatctgataaatatacaatagatgcaaggtataacctaaaacccatgtatagaatcaagggagaatctgaagaagatac
cctctttatcaaacagatggtagaacaatgtgtgacatcccaggaattggtggaaaaagtgttgaagatactgtttagagatttgttcaaga
gtggagaatacaaagcgtacagatacgatgatgatgtagaaaatggatttattggattggatacactaaaattaaacattgttcatgatata
gttgaaccatgtatgcctgttcgtaggccagtggctaagatactgtgtaaagaaatggtaaataaatactttgagaatccgctacatattatt
ggtaaaaatcttcaagagtgcattgactttgttagtgaataggcatttcatctttctccaatactaattcaaattgttaaattaataatggatag
tataaatagttattagtgataaaatagtaaaaataattattagaataagagtgtagtatcatagataactctcttctataaaaatggattttat
tcgtagaaagtatcttatatacacagtagaaaataatatagatttttttaaaggatgatacattaagtaaagtaaacaattttaccctcaatcat
gtactagctctcaagtatctagttagcaattttcctcaacacgttattactaaggatgtattagctaataccaattttttttgttttcatacatatgg
tacgatgttgtaaagtgtacgaagcggttttacgacacgcatttgatgcacccacgttgtacgttaaagcattgactaagaattatttatcgttt

FIG. 12M agtaacgcaatacaatcgtacaaggaaaccgtgcataaactaacacaagatgaaaaatttttagaggttgccgaatacatggacgaatta
ggagaacttataggcgtaaattatgacttagttcttaatccattatttcacggaggggaacccatcaaagatatggaaatcatttttttaaaac
tgtttaagaaaacagacttcaaagttgttaaaaaattaagtgttataagattacttatttgggcatacctaagcaagaaagatacaggcata
gagtttgcggataatgatagacaagatatatatactctatttcaacaaactggtagaatcgtccatagcaatctaacagaaacgtttagaga
ttatatctttcccggagataagactagctattgggtgtggttaaacgaaagtatagctaatgatgcggatatcgttcttaatagacacgccatt
accatgtatgataaaattcttagttatatatactctgagataaaacagggacgcgttaataaaaacatgcttaagttagtttatatctttgagc
ctgaaaaagatatcagagaacttctgctagaaatcatatatgatattcctggagatatcctatcattattgatgcaaaaaacgacgattgga
aaaaatattttattagtttttataaagctaatttttattaacggtaatacatttattagtgatagaacgtttaacgaggacttattcagagttgttgt
tcaaatagatcccgaatatttcgataatgaacgaattatgtctttattctctacgagtgctgcggacattaaacgatttgatgagttagatatta
ataacagttatatatctaatataatttatgaggtgaacgatatcacattagatacaatggatgatatgaagaagtgtcaaatctttaacgagg
atacgtcgtattatgttaaggaatacaatacatacctgttttgcacgagtcggatcccatggtcatagagaacggaatactaaagaaactg
tcatctataaaatccaagagtagacggctgaacttgtttagcaaaaacattttaaaatattatttagacggacaattggctcgtctaggtcttg
tgttagatgattataaaggagacttgttagttaaaatgataaaccatcttaagtctgtggaggatgtatccgcattcgttcgattttctacagat
aaaaaccctagtattcttccatcgctaatcaaaactattttagctagttataaatatttccatcatcgtcttatttcaaaggttttaagagataat
ctatatcatgtagaagaattcttggataaaagcatccatctaaccaagacggataagaaatatatacttcaattgataagacacggtagatc
atagaacagaccaaatatattattaataatttgtatatacatagatataattatcacatattaaaaattcacacatttttgataaatgggaact
gctgcaacaattcagactcccaccaaattaatgaataaagaaaatgcagaaatgattttggaaaaaattgttgatcatatagttatgtatatt
agtgacgaatcaagtgattcagaaaataatcctgaatatattgattttcgtaacagatacgaagactatagatctctcattataaaaagtgat
cacgagtttgtaaagctatgtaaaaatcatgcagagaaaaagttctccagaaacgcaacaaatgattatcaaacacatatacgaacaatat
cttattccagtatctgaagtactattaaaacctataatgtccatgggtgacataattacatataacggatgtaaagacaatgaatggatgcta
gaacaactctctaccctaaactttaacaatctccgcacatggaactcatgtagcataggcaatgtaacgcgtctgttttatacatttttttagtta
tctgatgaaagataaactaaatatataagtataatcccattctaatactttaacctgatgtattagcatcttattagaatattaacctaactaa
aagacataacataaaaactcattacatagttgataaaaagcggtaggatataaatattatggctgccaccgttccgcgtttttgacgacgtgt
acaaaaatgcacaagaagaattctagatcaagaaacattttttagtagaggtctaagtagaccgttaatgaaaaacacatatctatttgat
aattacgcgtatggatggataccagaaactgcaatttggagtagtagatacgcaaacttagatgcaagtgactattatcccatttcgttggg
attacttaaaaagttcgagtttctcatgtctctatataaaggtcctattccagtatacgaagaaaaagtaaatactgaattcattgctaatgga
tcgttctctggtagatacgtatcatatcttcgaaagttttctgctcttccaacaaacgagtttattagttttttgttactgacttccattccaatcta
taatatcttgttctggtttaaaaatactcagtttgatattactaaacacacattattcagatacgtctatacagataatgccaaacacctggcg
ttggctaggtatatgcatcaaacaggagactataagcctttgtttagtcgtctcaaagagaattatatatttaccggtcccgttccaataggta
tcaaagatataaatcaccctaatcttagtagagcaagaagtccatccgattatgagacattagctaatattagtactatattgtactttaccaa
gtatgatccggtattaatgttttattgttttacgtacctgggtattcaattactacaaaaattactccagccgtagaatatctaatggataaact
gaatctaacaaagagcgacgtacaactgttgtaaattattttatgcttcgtaaaatgtaggttttgaaccaaacattctttcaaagaatgaga
tgcataaaactttattatccaatagattgactatttcggacgtcaatcgtttaaagtaaacttcgtaaaatattctttgatcactgccgagttta
aaacttctatcgataattgtttcatatgttttaatatttacaagttttttggtccatggtacattagccggacaaatatatgcaaaataatatcgt
tctccaagttctatagtttctggattattttattatattcagtaaccaaatacatattagggttatctgcggatttataatttgagtgatgcattcg
actcaacataaataattctagaggagacgatctactatcaaattcggatcgtaaatctgtttctaaagaacggagaatatctatacatacct
gattagaattcatccgtccttcagacaacatctcagacagtctggtcttgtatgtcttaatcatattcttatgaaacttggaaacatctcttctag
tttcactagtacctttattaattctctcaggtacagattttgaattcgacgatgccgagtatttcatcgttgtatatttcttcttcgattgcataatc
agattcttatataccgcctcaaactctatttaaaattattaaacaatactctattattaatcagtcgttctaactcctttgctatttctatggactt
atctacatcttgactgtctatctctgtaaacacggagtcggtatctccatacacgctacgaaaacgaaatcgtaatctataggcaacgatgt
tttcacaatcggattaatatctctatcgtccatataaaatggattacttaatggattggcaaaccgtaacataccgttagataactctgctcca
tttagtaccgattctagatacaagatcattctacgtcctatggatgtgcaactcttagccgaagcgtatgagtatagagcactatttctaaatc
ccatcagaccatatactgagttggctactatcttgtacgtatattgcatggaatcatagatggccttttcagttgaactggtagcctgttttaac
atcttttttatatctggctctctctgccaaaaatgttcttaatagtctaggaatggttccttctatcgatctatcgaaaattgctatttcagagatga

FIG. 12N ggttcggtagtctaggttcacaatgaaccgtaatatatctaggaggtggatatttctgaagcaagagctgattatttatttcttcttccaatcta
ttggtactaacaacgacaccgactaatgtttccggagatagatttccaaagatacacacattaggatacagactgttataatcaaagattaa
tacattattactaaacatttttttgttttggagcaaataccttaccgccttcataaggaaacttttgttttgtttctgatctaactaagatagttttag
tttccaacaatagctttaacagtggacccttgatgactgtactcgctctatattcgaataccatggattgaggaagcacatatgttgacgcac
ccgcgtctgtttttgtttctactccataatactcccacaaatactgacacaaacaagcatcatgaatacagtatctagccatatctaaagctat
gtttagattataatccttatacatctgagctaaatcaacgtcatcctttccgaaagataatttatatgtatcattaggtaaagtaggacataata
gtacgactttaaatccattttcccaaatatctttacgaattactttacatataatatcctcatcaacagtcacataattacctgtggttaaaacct
ttgcaaatgcagcggctttgcctttcgcgtccgtagtatcgtcaccgatgaacgtcatttctctaactcctctatttaatactttacccatgcaac
tgaacgcgttcttggatatagaatccaatttgtacgaatccaatttttcagattttgaatgaatgaatatagatcgaaaaatatagttccatta
ttgttattaacgtgaaacgtagtattggccatgccgcctactcccttatgactagactgatttctctcataaatacagagatgtacagcttcctt
tttgtccggagatctaaagataatcttctctcctgttaataactctagacgattagtaatatatctcagatcaaagttatgtccgttaaaggtaa
cgacatagtcgaacgttagttccaacaattgtttagctattcgtaacaaaactatttcagaacataaaactagttctcgttcgtaatccatttcc
attagtgactgtatcctcaaacatcctctatcgacggcttcttgtatttcctgttccgttaacatctcttcattaatgagcgtaaacaataatcgt
ttaccacttaaatcgatataacagtaacttgtatgcgagattgggttaataaatacagaaggaaacttcttatcgaagtgacactctatatct
agaaataagtacgatcttgggatatcgaatctaggtatttttttagcgaaacagttacgtggatcgtcacaatgataacatccattgttaatct
ttgtcaaatattgctcgtccaacgagtaacatccgtctggagatatcccgttagaaatataaaaccaactaatattgagaaattcatccatgg
tggcattttgtatgctgcgtttctttggctcttctatcaaccacatatctgcgacggagcattttctatctttaatatctagattataacttattgtc
tcgtcaatgtctatagttctcatctttcccaacggcctcgcattaaatggaggaggagacaatgactgatatatttcgtccgtcactacgtaat
aaaagtaatgaggaaatcgtataaatacggtctcaccatttcgacatctggatttcagatataaaaatctgttttcaccgtgactttcaaacc
aattaatgcaccgaacatccatttatagaatttagaaatatattttcatttaaatgaatcccaaacattggggaagagccgtatggaccatta
tttttatagtactttcgcaagcgggtttagacggcaacatagaagcgtgtaaacgaaaactatatactatagttagcactcttccatgtcctgc
atgtagacggcacgcgactatcgctatagaggacaataatgtcatgtctagcgatgatctgaattatatttattatttttttcatcagattattta
acaatttggcatctgatcccaaatacgcgatcgatgtgacaaaggttaacccttatataacttaacccattataaaacttatgattagtcacg
actgaaataaccgcgtgattatttttggtataattctacacggcatggtttctgtgactatgaattcaaccccccgttacattagtgaaatcttta
acaaacagcaagggttcgtcaaagacataaaactcattgtttacaatcgaaatagaccccctatcacacttaaaataaaaaatatccttat
cctttaccaccaaataaaattctgattggtcaatgtgaatgtattcacttaacagttccacaaatttatttattaactccgaggcacatacatcg
tcggtatttttatggcaaactttactcttccagcatccgtttctaaaaaaatattaacgagttccatttatatcatccaatattattgaaatgac
gttgatggacaaatgatacaaataagaaggtacggtacctttgtccaccatctcctccaattcatgctctattttgtcattaactttaatgtatg
aaaacagtacgccacatgcttccatgacagtgtgtaacactttggatacaaaatgtttgacattagtataattgttcaagactgtcaatctat
aatagatagtagctataatatattctatgatggtattgaagaagatgacaaccttggcatattgatcatttaacacagacatggtatcaacag
atagcttgaatgaaagagaatcagtaattggaataagcgtcttctcgatggagtgtccgtataccaacatgtctgatattttgatgtattccat
taaattatttagtttttttcttttttattctcgttaaacagcatttctgtcaacggaccccaacatcgttgaccgattaagttttgattgattttccgtg
taaggcgtatctagtcagatcgtatagcctatccaataatccatcgtctgtgcgtagatcacatcgtacacttttttaattctctatagaagagc
gacagacatctggagcaattacagacagcaatttctttattctctacagatgtaagatacttgaagacattcctatgatgatgcagaattttgg
ataacacggtattgatggtatctgttaccataattcctttgatggctgatagtgtcagagcacaagatttccaatctttgacaatttttagcacc
attatctttgtttgatatctatatcagacagcatggtgcgtctgacaacacaaggattaagacggaaagatgaaatgattctctcaacatctt
caatggataccttgctatttttctggcattatctatatgtgcgagaatatcctctagagaatcagtatccttttttgatgatagtggatctcaatg
acatgggacgtctaaaccttcttattctatcaccagattgcatggtgatttgtcttctttcttttatcataatgtaatctctaaattcatcggcaaa
ttgtctatatctaaaatcataatatgagatgtttacctctacaaatatctgttcgtccaatgttagagtatttacatcagttttgtattccaaatta
aacatggcaacggatttaattttatattcctctattaagtcctcgtcgataataacagaatgtagataatcatttaatccatcgtacatggttgg
aagatgctcgttgacaaaatctttaattgtcttgatgaaggtgggactatatctaacatcttgattaataaaatttataacattgtccataggat
actttgtaactagttttatacacatctcttcatcggtaagtttagacagaatatcgtgaacaggtggtatattatattcatcagatatacgaaga
acaatgtccaaatctatattgtttaatatattatatagatgtagtgtagctcctacaggaatatctttaactaagtcaatgatttcatcaaccgtt
agatctattttaaagttaatcatataggcattgattttttaaaaggtatgtagccttgactacattctcattaattaaccattccaagtcactgtgt

FIG. 12O gtaagaagattatattctatcataagcttgactacatttggtcccgataccattaaagaattcttatgatataaggaaacagattttaggtact
catctactctacaagaattttggagagccttaacgatatcagtgacgtttattatttcaggaggaaaaaacctaacattgagaatatcggaat
taatagcttccagatacagtgattttggcaatagtccgtgtaatccataatccagtaacacgagctggtgcttgctagacacctttttcaatgtt
aattttttttgaaataagctttgataaagccttcctcgcaaattccggatacatgaacatgtcggcgacatgattaagtattgtttttttcattatttt
tatattttctcaacaagttctcaataccccaatagatgatagaatatcacccaatgcgtccatgttgtctatttccaacaggtcgctatatccac
caatagaagtttttcccaaaaaagattctaggaacagttctaccaccagtaatttgttcaaaatagtcacgcaattcattttcgggtttaaattc
tttaatatcgacaatttcatacgctcctcttttgaaactaaacttatttagaatatccagtgcatttctacaaaaaggacatgtatacttgacaa
aaattgtcactttgttattggccaacctttgttgtacaaattcctcggccattttaatatttaagtgatataaaactatctcgacttatttaactctt
tagtcgagatatatggacgcagatagctatatgatagccaactacagaaggcaaacgctataaaaaacataattacgacgagcatatttat
aaatatttttattcagcattacttgatatagtaatattaggcacagtcaaacattcaaccactctcgatacattaactctctcattttctttaaca
aattctgcaatatcttcgtaaaaagattcttgaaacttttttagaatatctatcgactctagatgaaatagcgttcgtcaacatactatgttttgta
tacataaaggcgcccattttaacagtttctagtgacaaaatgctagcgatcctaggatcctttagaatcacatagattgacgattcgtctctct
tagtaactctagtaaaataatcatacaatctagtacgcgaaataatattatccttgacttgaggagatctaaacaatctagttttgagaacat
cgataagttcatcgggaatgacatacatactatctttaatagaactcttttcatccagttgaatggattcgtccttaaccaactgattaatgag
atcttctattttatcattttccagatgatatgtatgtccattaaagttaaattgtgtagcgcttcttttttagtctagcagccaatactttaacatcac
taatatcgatatacaaaggagatgatttatctatggtattaagaattcgttttttcgacatctgtcaaaaccaattccttttttgcctgtatcatcca
gtttttccatcctttgtaaagaaattattttttctactagactattaataagactgataaaggattcctccataattgcacaatccaaacttttttcacaa
aactagactttacaagatctacaggaatgcgtacttcaggtttcttagcttgtgatttttttctttttgtggacattttcttgtgaccaactcatctac
catttcattgattttagcagtgaaataagctttcaatgcacgggcactgatactattgaaaacgagttgatcttcaaattccgccatttaagttc
accaaacaacttttaaatacaaatatatcaatagtagtagaataagaactataaaaaaaataataattaaccaataccaaccccaacaac
cggtattattagttgatgtgactgttttctcatcacttagaacagatttaacaatttctataaagtctgtcaaatcatcttccggagaccccataa
atacaccaaatatagcggcgtacaacttatccatttatacattgaatattggcttttctttatcgctatcttcatcatattcatcatcaatatcaa
caagtcccagattacgagccagatcttcttctacattttcagtcattgatacacgttcactatctccagagagtccgataacgttagccaccac
ttctctatcaatgattagtttcttgagtgcgaatgtaattttttgtttccgttccggatctatagaaaactacaggtgtgataattgccttggccaa
ttgtctttctcttttactgagtgattctagttcaccttctatagatctgagaatggatgattctccagtcgaaacatattctaccatggctccgttt
aatttgttgatgaagatggattcatccttaaatgttttctctgtaatagtttccaccgaaagactatgcaaagaatttggaatgcgttccttgtg
cttaatgtttccatagacggcttctagaagttgatacaacataggactagccgcggtaactttttattttttagaaagtatccatcgcttctatctt
gtttagatttattttttataaagtttagtctctccttccaacataataaaagtggaagtcatttgactagataaactatcagtaagttttatagaga
tagacgaacaattagcgtattgagaagcatttagtgtaacgtattcgatacattttgcattagatttactaatcgattttgcatactctataaca
cccgcacaagtctgtagagaatcgctagatgcagtaggtcttggtgaagtttcaactctcttcttgattaccttactcatgattaaacctaaat
aattgtactttgtaatataatgatatatattttcactttatctcatttgagaataaaaatgtttttgtttaaccactgcatgatgtacagatttcgg
aatcacaaaccaccggtggtttattttatccttgtccaatgtgaattgaatgggagcggatgcgggtttcgtacgtagatagtacattcccgt
ttttagaccgagactccatccgtaaaaatgcatactcgttagtttggaataactcggatctgctatatggatattcatagattgactttgatcga
tgaaggctcccctgtctgcagccatttttatgatcgtcttttgtggaatttcccaaatagtttatataaactcgcttaatatcttctggaaggtttgt
attctgaatggatccaccatctgccataatcctattcttgatctcatcattccataattttctctcggttaaaactctaaggagatgcggattaa
ctacttgaaattctccagacaatactctccgagtgtaaatattactggtatacggttccaccgactcattatttcccaaaatttgagcagttgat
gcagtcggcataggtgccaccaataaactatttctaagaccgtatgttctgatttatctttttagaggttcccaattccaaagatccgacggta
caacattccaaagatcatattgtagaataccgttactggcgtacgatcctacatatgtatcgtatggtccttccttctcagctagttcacaactc
gcctctaatgcaccgtaataaatggtttcgaagatcttcttatttagatcttgtgcttccaggctatcaaatggataatttaagagaataaacg
cgtccgctaatccttgaacaccaataccgataggtctatgtctcttattagagatttcagcttctggaataggataataattaatatctataatt
ttattgagatttctgacaattactttgaccacatccttcagtttgagaaaatcaaatcgcccatctattacaaacatgttcaaggcaacagatg
ccagattacaaacggctacctcattagcatccgcatattgtattatctcagtgcaaagattactacacttgatagttcctaaattttgttgatta
ctcttttttgttacacgcatcccttataaagaatgaatggagtaccagtttcaatctgagattctataatcgctttccagacgactcgagcctttatt
atagatttgtatctcctttctctttcgtatagtgtatacaatcgttcgaactcgtctccccaaacattgtccaatccaggacattcatccggacac

FIG. 12P atcaacgaccactctccgtcatccttcactcgtttcataaagagatcaggaatccaaagagctataaatagatctctggttctatgttcctcgt
ttcctgtattctttttaagatcgaggaacgccataatatcagaatgccacggttccaagtatatggccataactccaggccgtttgtttcctccc
tgatctatgtatctagcggtgttattataaactctcaacattggaataataccgtttgatataccattggtaccggagatatagcttccactggc
acgaatattactaattgatagacctattccccctgccattttagagagagattaatgcgcatcgtttttaacgtgtcatagatacctctatgctatcatc
gatcatgttaagtagaaaacagctagacatttggtgacgactagttcccgcattaaataaggtaggagaagcgtgcgtaaaccattttttcag
aaagtagattgtacgtctcaatagctgagtctatatcccattgatgaattcctactgcgacacgcattaacatgtgctgaggtctttcaacgat
cttgttgtttattttcaacaagtaggattttttccaaagtttttaaaaccaaaatagttgtatgaaaagtctcgttcgtaaataataaccgagttga
gtttatccttatatttgttaactatatccatggtgatacttgaaataatcggagaatgtttcccattttttaggattaacatagttgaataaaatcctc
catcacttcactaaatagttttttttgtttccttgtgtagatttgatacggctattctggcggctagaatggcataatccggatgttgtgtagtaca
agtggctgctatttcggctgccagagtgtccaattctaccgttgttactccattatatattccttgaataaccttcatagctattttaataggatct
atatgatccgtgtttaagccataacataattttctaatacgagacgtgatttttatcaaacatgacattttccttgtatccatttcgtttaatgaca
aacattttgttggtgtaataaaaaaattatttaacttttcattaatagggatttgacgtacgtagcgtacaaaatgattgttcctggtatatag
ataaagagtcctatatatttgaaaatcgttacggctcgattaaactttaatgattgcatagtgaatatatcattaggatttaactccttgactat
cagggcggcaccagaaattaccatcaaaagcattaatacagttatgcctatcgcagttagaacggttatagcatccaccatttatatctaaa
aattagatcaaagaatatgtgacaaagtcctagttgtatattgagaattgacaaaacaatgtttcttacatattttttttttattagtaaccgact
taatagtaggaactggaaaactagacttgattattctataagtatagatacccttccaaataatattctctttgataaaagttccagaaaatgt
agaatttttaaaaagttatcttttgctattaccaagattgtgtttagacgcttattattaatatgagtgatgaaatccacaccgcctctagatat
cgcctttatttccacattagatggtaaatccaatagtgaaactatctttttaggaatgtatggactcgcgtttagaggagtgaacgtcttgggc
gtcggaaaggatgattcgtcaaacgaataaacaatttcacaaatggatgttaatgtattagtaggaaattttttgacgctagtggaattgaa
gattctaatggatgatgttctacctatttcatccgataacatgttaatttccgacaccaacggttttaatatttcgatgatatacggtagtctctc
tttcggacttatatagcttattccacaatacgagtcattatatactccaaaaaacaaaataactagtataaaatctgtatcgaatgggaaaa
acgaaattatcgacataggtatagaatccggaacattgaacgtattaatacttaattctttttctgtggtaagtaccgataggttattgacattg
tatggtttttaaatattctataacttgagacttgatagatattagtgatgaattgaaaattattttatcaccacgtgtgtttcaggatcatcgtcg
acgcccgtcaaccaaccgaatggagtaaaataaatatcattaatatatgctctaaatattagtatttttattaatcctttgattatcatcttctcg
tacgcgaatgattccatgatcaagagtgatttgagaacatcctccggagtattaatgggcttagtaaacagtacatcgttgcaataataaaa
gttatccaagttaaaggatattatgcattcgtttaaagatatcacctcatctgacggagacaatttttttggtaggttttagagactttgaagcta
cttgtttaacaaagttattcatcgtcgtttactattctatttaattttgtagttaatttatcacatatcacattaattgacttttttggtccacttttcca
tacgtttatattcttttaatcctgcgttatccgtttccgttatatccagtgatagatcgtgcaggttaaatagaatgctcttaaataatgtcattttc
ttatccgctaaaaatttaaagaatgtataaacctttttcagagatttgaaactcttaggtggtgtcctagtacacaatatcataaacaaacta
ataaacattccacattcagattccaacagctgattaacttctacattaatacagcctattttcgctccaaatgtacattcgaaaaatctgaata
aaacatcgatgtcacaatttgtattatccaatacagaatgtctgtgattcgtgttaaaaccatcggagaaggaatagaaataaaaattattat
agtggtggaattcagttggaatattgcctccggagtcataaaaggatactaaacattgttttttatcataaattacacatttccaatgagacaa
ataacaaaatccaaacattacaaatctagaggtagaactttttaattttgtctttaagtatatacgataagatatgtttattcataaacgcgtca
aattttttcatgaatcgctaaggagtttaagaatctcatgtcaaattgtcctatataatccacttcggatccataagcaaactgagagactaag
ttcttaatacttcgattgctcatccaggctcctctctcaggctctattttcatcttgacgacctttggattttcaccagtatgtattcctttacgtgat
aaatcatcgattttcaaatccatttgtgagaagtctatcgccttagatactttttcccgtagtcgaggtttaaagaaatacgctaacggtatact
agtaggtaactcaaagacatcatatatagaatggtaacgcgtctttaactcgtcggttaactctttcttttgatcgagttcgtcgctactattgg
gtctgctcaggtgccccaactctactagttccaacatcataccgataggaatacaagacactttgccagcggttgtagatttatcatatttctc
cactacatatccgttacaatttgttaaaaatttagatacatctatattgctacataatccagctagtgaatatatatgacataataaattggta
aatcctagttctggtatttactaattactaaatctgtatatcttccatttatcatggaaaagaatttaccagatatcttcttttttccaaactgcg
ttaatgtattctcttacaaatattcacaagatgaattcagtaatatgagtaaaacggaacgtgatagtttctcattggccgtgtttccagttata
aaacatagatggcataacgcacacgttgtaaaacataaaggaatatacaaagttagtacagaagcacgtggaaaaaaagtatctcctcc
atcactaggaaaacccgcacacataaacctaaccgcgaagcaatatatatacagtgaacacacaataagctttgaatgttatagttttcta
aaatgtataacaaatacagaaatcaattcgttcgatgagtatatattaagaggactattagaagctggtaatagtttacagatattttccaatt

FIG. 12Q ccgtaggtaaacgaacagatactataggtgtactagggaataagtatccatttagcaaaattccattggcctcattaactcctaaagcacaa
cgagagatattttcagcgtggatttctcatagacctgtagttttaactggaggaactggagtgggtaagacgtcacaggtacccaagttattg
ctttggtttaattatttatttggtggattctctactctagataaaatcactaactttcacgaaagaccagtcattctatctcttcctaggatagctt
tagttagattgcatagcaataccattttaaaatcattgggatttaaggtactagatggatctcctatttctttacggtacggatctataccggaa
gaattaataaacaaacaaccaaaaaaatatggaattgtattttctacccataagttatctctaacaaaactatttagttatggcactcttatta
tagacgaagttcatgagcatgatcaaataggagatattattatagcagtagcgagaaagcatcatacgaaaatagattctatgtttttaatg
actgccacgttagaggatgaccgagaacggctaaaagtattttacctaatcccgcatttatacatattcctggagatacactgtttaaaatt
agcgaggtatttattcataataagataaatccatcttccagaatggcatacatagaagaagaaaagagaaatttagttactgctatacagat
gtatactcctcctgatggatcatccggtatagtctttgtggcatccgttgcacagtgtcacgaatataaatcatatttagaaaaaaagattaccg
tatgatatgtatattattcatggtaaggtcttagatatagacgaaatattagaaaaagtgtattcatcacctaatgtatcgataattatttctac
tccttatttggaatccagcgttactatacgcaatgttacacacatttatgatatgggtaaagtttttgtccccgctcctttggaggatcgcaag
aatttatttctaaatctatgagagatcaacgaaaaggaagagtaggaagagttaatcctggtacatacgtctatttctatgatctgtcttatat
gaagtctatacagcgaatagattcagaatttctacataattatatattgtacgctaataagtttaatctaacactccccgaagatttgtttataa
tccctacaaatttggatattctatggcgtacaaaggaatatatagactcgttcgatattagtacagaaacatggaataaattattatccaatt
attatatgaagatgatagagtatgctaaactttatgtactaagtcctattctcgctgaggagttggataactttgagaggacgggagaattaa
ctagtattgtacgagaagccattttatctctaaatttacgaattaagattttaaattttaaacataaagatgatgatacgtatatacacttttgta
aaatattattcggtgtctataacggaacaaacgctactatatattatcatagacctctaacgggatatatgaatatgatttcagatactatatt
tgttcctgtagataataactaaaaatcaaactctaatgaccacatctttttttagagatgaaaaattttccacatctcctttttgtagacacgact
aaacattttgcagaaaaaagtttattagtgtttagataatcgtatacttcatcagtgtagatagtaaatgtgaacagataaaaggtattcttgc
tcaatagattggtaaattccatagaatatattaatcctttcttcttgagatcccacatcatttcaaccagagacgtttatccaatgatttacctc
gtactataccacatacaaaactagattttgcagtgacgtcgtacctggtattcctaccaaacaaaattttactttttagttcttttagaaaattct
aaggtagaatctctatttgccaatatgtcatctatggaattaccactagcaaaaaatgatagaaatatatattgatacatcgcagctggtttt
gatctactatactttaaaaacgaatcagattccataattgcctgtatatcatcagctgaaaaactatgtttacacgtattccttcggcatttctt
tttaatgatatatcttgtttagacaatgataaagttatcatgtccatgagagacgcgtctccgtatcgtataaatatttcattagatgttagacg
cttcattagggggtatacttctataaggtttcttaattagtccatcatttgttgcgtcaagaactactatcggatgttgttgggtatctctagtgtta
cacatggccttactaaagtttgggtaaataactatgatatctctattaattatagatgcatatatttcatttgtcaaggatattagtatcgacttg
ctatcgtcattaatacgtgtaatgtaatcatatataaatcatgcgatagccaaggaaaattcaaatagatgttcatcatataatcgtcgctataat
tcatattaatactttgacattgactaatttgtaatatagcctcgccacgaagaaagctctcgtattcagtttcatcgataaaggataccgttaa
atataactggttgccgatagtctcatagtctattaagtggtaagtttcgtacaaatacagaatccctaaaatattatctaatgttggattaatct
ttaccataactgtataaaatggagacggagtcataactattttaccgtttgtacttactggaatagacgaaggaataatctccggacatgctg
gtaaagacccaaatgtctgtttgaagaaatccaatgttccaggtcctaatctcttaacaaaaattacgatattcgatcccgatatcctttgcat
tctatttaccagcatatcacgaactatattaagattatctatcatgtctattctcccaccgttatataaatcgcctccgctaagaaacgttagta
tatccatacaatggaatacttcatttctaaaatagtattcgtttctaattctttaatgtgaaatcgtatactagaaagggaaaaattatctttga
gtttccgttagaaaagaaccacgaaactaatgttctgattgcgtccgattccgttgctgaattaatggatttacaccaaaaactcatataact
tctagatgtagaagcattcgctaaaaaattagtagaatcaaaggatataagtagatgttccaacaagtgagcaattcccaagatttcatcta
tatcattctcgaatccgaaattagaaattcccaagtagatatccttttttcatccgatcgttgatgaaaatacgaactttattcggtaagacaatc
atttactaaggagtaaaataggaagtaatgttcgtatgtcgttatcatcgtataaattaaaggtgtgttttttaccattaagtgacattataattt
taccaatattggaattataatataggtgtatttgcgcactcgcgacggttgatgcatcggtaaatatagctgtatctaatgttctagtcggtatt
tcatcatttcgctgtctaataatagcgttttctctatctgtttccattacagctgcctgaagtttattggtcggataatatgtaaaataataagaa
atacatacgaataacaaaaataaaataagatataataaagatgccatttagagatctaattttgtttaacttgtccaaattcctacttacaga
agatgaggaatcgttggagatagtgtcttccttatgtagaggatttgaaatatcttatgatgacttgataacttacttccagataggaaatac
cataaatatatttctaaagtatttgaacatgtagatttatcggaggaattaagtatggaattccatgatcaactctgagagatttagtctatct
tagattgtacaagtattccaagtgtatacggccgtgttataaattaggagataatctaaaaggcatagttgttataaaggacaggaatattta
tattagagaagcaaatgatgacttgatagaatatctcctcaaggaatacactcctcagatttatacatattctaatgagcgcgtccccataac

FIG. 12R tggttcaaaattaattctttgtggattttctcaagttacatttatggcgtatacaacgtcgcatataacaacaaataaaaaggtagatgttctc gtttccaaaaaatgtatagatgaactagtcgatccaataaattatcaaatacttcaaaatttatttgataaaggaagcggaacaataaacaa aatactcaggaagatattttattcggtaaccggtggccaaactccataatttgctttttctatttcggattttagaatttccaaattcaccagcga tttatcggttttggtgaaatccaaggatttattaatgtccacaaatgccatttgttttgtctgtggattgtatttgaaaatggaaacgatgtagtt agatagatgcgctgcaaagtttcctattagggttccgcgctttacgtcacccagcatacttgaatcaccatcctttaaaaaaaatgataagat atcaacatggagtatatcatactcggattttaattcttctactgcatcactgacattttcacaaatactacaatacggtttaccgaaaataatc agtacgttcttcatttatgggtatcaaaaacttaaaatcgttactgctggaaaataaatcactgacgatattagatgataatttatacaaagta tacaatggaatatttgtggatacaatgagtatttatatagccgtcgccaattgtgtcagaaacttagaagagttaactacggtattcataaaa tacgtaaacggatgggtaaaaaagggagggcatgtaaccctttttatcgatagaggaagtataaaaattaaacaagacgttagagacaa gagacgtaaatattctaaattaaccaaggacagaaaaatgctagaattagaaaagtgtacatccgaaatacaaaatgttaccggatttatg gaagaagaaataaaggcagaaatgcaattaaaaatcgataaactcacatttcaaatatatttatctgattctgataacataaaaatatcatt gaatgagatactaacacatttcaacaataatgagaatgttacattattttattgtgatgaacgagacgcagaattcgttatgtgtctcgaggct aaaacacatttctctaccacaggagaatggccgttgataataagtaccgatcaggatactatgctatttgcatctactgataatcatcctaag atgataaaaaacttaactcaactgtttaaatttgttccctcggcagaggataactatttagcaaaattaacggcgttagtgaatggatgtgat ttctttcctggactctatggggcatctataacacccaccaacttaaacaaaatacaattgtttagtgattttacaatcgataatatagtcacta gtttggcaattaaaaattattatagaaagactaactctaccgtagacgtgcgtaatattgttacgtttataaacgattacgctaatttagacga tgtctactcgtatgttcctccttgtcaatgcactgttcaagaatttatattttccgcattagatgaaaaatggaacaattttaaatcatcttattta gagaccgttccgttaccctgccaattaatgtatgcattagaaccacgcaaggagattgatgtttcagaagttaaaactttatcatcttatatag atttcgaaaatactaaatcagatatcgatgttataaaatctatatcttcgatcttcggatattctaacgaaaactgtaacactatagtgttcgg catctataaggataatttactactgagtataaatagttcattttactttaacgatagtctgttaataaccaatactaaaagtgataatataata aatataggttactagattaaaaatggtgttccaactcgtgtgctctacatgcggcaaagatatttctcacgaacgatataaattgattatacg aaaaaaatcattaaaggatgtactcgtcagtgtaaagaacgaatgttgtaggttaaaattatctacacaaatagaacctcaacgtaactta acagtgcaacctctattggatataaactaatatggatccggttaatttatcaagacatatgcgcctagaggttctattattttattaattatac catgtcattaacaagtcatttgaatccatcgatagaaaaacatgtgggtatttattatggtacgttattatcggaacacttggtagttgaatct acctatagaaaaggagttcgaatagtcccattggatagtttttttgaaggatatcttagtgcaaaagtatacatgttagagaatattcaagtta tgaaaatagcagctgatacgtcattaactttattgggtattccgtatggatttggtcatgatagaatgtattgtttttaaattggtagctgaatgtt ataaaaatgccggtattgatacatcgtctaaacgaatattaggtaaagatattttttctgagccaaaacttcacagatgataatagatggata aagatatatgattctaataatttaacattttggcaaattgattaccttaaagggtgagttaatatgcataactactcctccgttgttttttccctc gttctttttcttaacgttgtttgccatcactctcataatgtaaagatattctaaaatggtaaacttttgcatatcggacgcagaaattggtataaa tgttgtaattgtattatttcccgtcaatggactagtcacagctccatcagttttatatcctttagagtatttctcactcgtgtctaacattctagag cattccatgatctgtttatcgttgatattggccggaaagatagattttttatttttttattatattactattggcaattgtagatataacttctggtaa atattttttctacctttttcaatctcttctattttcaagccggctatatattctgctatattgttgctagtatcaataccttttctggctaagaagtcata tgtggtattcactatatcagttttaactggtagttccattagcctttccacttctgcagaataatcagaaattggttctttaccagaaaatccagc tactataataggctcaccgatgatcattggcaaaatcctatattgtaccagattaatgagagcatatttcatttccaataattctgctagttctt gagacattgatttatttgatgaatctagttggttctctagatactctaccatttctgccgcatacaataacttgttagataaaatcagggttatc aaagtgtttagcgtggctagaatagtgggcttgcatgtattaaagaatgcggtagtatgagtaaaccgttttaacgaattatatagtctccag aaatctgtggcgttacatacatgagccgaatgacatcgaagattgtccaatattttttaatagctgctctttgtccattatttctatatttgactcg caacaattgtagataccattaatcaccgattccttttttcgatgccggacaatagcacaattgtttagctttggactctatgtattcagaattaat agatatatctcttaatacagattgcactatacattttgaaactatgtcaaaaattgtagaacgacgctgttctgcagccatttaactttaaata atttacaaaaaatttaaaatgagcatccgtataaaaaatcgataaactgcgcccaaattgtggcatatttttcagagttcagtgaagaagtatcta taaatgtagactcgacggatgagttaatgtatattttgccgccttgggcggatctgtaaacatttgggccattatacctctcagtgcatcagt gttctaccgcggagccgaaaacattgtgtttaatcttcctgtgtccaaggtaaaatcgtgtttgtgtagttttcacaatgatgccatcatagata tagaacctgatctggaaaataatctagtaaaactttctagttatcatgtagtaagtgtcgattgtaacaaggaactgatgcctattaggacag atactactatttgtctaagtatagatcaaaagaaatcttacgtgtttaattttcacaagtatgaagaaaaatgttgtggtagaaccgtcattca

FIG. 12S tttagaatggttgttgggctttatcaagtgtattagtcagcatcagcatttggctattatgtttaaagatgacaatattattatgaagactcctgg
taatactgatgcgttttccagggaatattctatgactgaatgttctcaagaactacaaaagttttctttcaaaatagctatctcgtctctcaaca
aactacgaggattcaaaaagagagtcaatgttttttgaaactagaatcgtaatggataatgacgataacattctaggaatgttgttttcggata
gagttcaatcctttaagatcaacatctttatgacgttttttagattaatactttcaatgagataaatatgggtggcggagtaagtgttgagctccc
taaacgggatccgcctccgggagtacccactgatgagatgttattaaacgtggataaaatgcatgacgtgatagctcccgctaagcttttag
aatatgtgcatataggaccactagcaaaagataaagaggataaagtaaagaaaagatatccagagtttagattagtcaacacaggaccc
ggtggtctttcggcattgttaagacaatcgtataatggaaccgcacccaattgctgtcgcacttttaatcgtactcattattggaagaaggatg
gaaagatatcagataagtatgaagagggtgcagtattagaatcgtgttggccagacgttcacgacaccggaaaatgcgatgttgatttattc
gactggtgtcagggggatacgttcgatagaaacatatgccatcagtggatcggttcagcctttaataggagtaatagaactgtagagggtc
aacaatcgttaataaatctgtataataagatgcaaacattatgtagtaaagatgctagtgtaccaatatgtgaatcattttgcatcatttacg
cgcacacaatacagaagatagcaaagagatgatcgattatattctaagacaacagtctgcggactttaaacagaaatatatgagatgtagt
tatcccactagagataagttagaagagtcattaaaatatgcggaacctcgagaatgttgggatccagagtgttcgaatgccaatgttaattt
cttgctaacacgtaattataataatttaggactttgcaatattgtacgatgtaatactagcgtgaacaacttacagatggataaaacttcctca
ttaagattgtcatgtggattaagcaatagtgatagattttctactgttcccgtcaatagagcaaaagtagttcaacataatattaaacactcgt
tcgacctaaaattgcatttgatcagtttattatctctcttggtaatatggatactaattgtagctatttaaatgggtgccgcggcaagcatacag
acgacggtgaatacactcagcgaacgtatctcgtctaaattagaacaagaagcgaatgctagtgctcaaacaaaatgtgatatagaaatc
ggaaatttttatatccgacaaaaccatggatgtaacctcactgttaaaaatatgtgctctgcggacgcggatgctcagttggatgctgtgtta
tcagccgctacagaaacatatagtggattaacaccggaacaaaaagcatacgtgccagctatgtttactgctgcgttaaacattcagacga
gtgtaaacactgttgttagagattttgaaaattatgtgaaacagacttgtaattctagcgcggtcgtcgataacaaattaaagatacaaac
gtaatcatagatgaatgttacggagccccaggatctccaacaaatttggaatttattaatacaggatctagcaaaggaaattgtgccattaa
ggcgttgatgcaattgacgactaaggccactactcaaatagcacctaaacaagttgctggtacaggagttcagtttttatatgattgttatcgg
tgttataatattggcagcgttgtttatgtactatgccaagcgtatgttgttcacatccaccaatgataaaatcaaacttattttagccaataagg
aaaacgtccattggactacttacatggacacattctttagaacttctccgatggttattgctaccacggatatgcaaaactgaaaatatattg
ataatattttaatagattaacatggaagttatcactgatcgtctagacgatatagtgaaacaaaatatagcggatgaaaaatttgtagatttt
gttatacacggtctagagcatcaatgtcctgctatacttcgaccattaattaggttgtttattgatatactattatttgttatagtaatttatatttt
acggtacgtctagtaagtagaaattatcaaatgttgttggcgttggtggcgctagtcatcacattaactatttttttattactttatactataatag
tactagactgacttctaacaaacatctcacctgccataaataaatgcttgatattaaagtcttctatttctaacactattccatctgtggaaaat
aatactctgacattatcgctaattgacacatcggtgagtgatatgcctataaagtaataatcttctttgggcacatataccagtgtaccaggtt
ctaacaacctatttactggtgctcctatagcatactttttctttaccttgagaatatccatcgtttgcttggtcaatagcgatatgtgattttttatc
aaccactcgaaaaagtaattggagtgttcatatcctctacgggctattgtctcatggccgtgtatgaaatttaagtaacacgactgtggtaga
tttgttctatagagccggttgccgcaaatagatagaactaccaatatgtctgtacaaatgttaaacattaattgattaacagaaaaaacaat
gttcgttctgggaatagaaaccagatcaaaacaaaattcgttagaatatatgccacgtttatacattgaatataaaataactacagtttgaa
aaataacagtatcatttaaacatttaacttgcggggttaatctcacaactttactgttttttgaactgttcaaaatatagcatagatccgtgaga
aatacgtttagccgcctttaatagaggaaatcccaccgcctttctggatctcaccaacgacgatagttctgaccagcaactcatttcttcatca
tccacctgtttttaacatataataggcaggagatagatatccgtcattgcaatattccttctcgtaggcacacaatctaatattgataaaatctc
cattctcttctctgcatttattatcttgtttcggtggctgattaggctgtagtcttggtttaggctttggtatatcgttgttgaatctattttggtcatt
aaatctttcatttcttcctggtatattttatcacctcgtttggttggattttttgtctatattatcgtttgtaacatcggtacgggtattcatttatcac
aaaaaaaacttctctaaatgagtctactgctagaaaacctcatcgaagaagataccatattttttgcaggaagtatatctgagtatgatgatt
tacaaatggttattgccggcgcaaaatccaaatttccaagatctatgctttctattttaatatagtacctagaacgatgtcaaaatatgagtt
ggagttgattcataacgaaaatatcacaggagcaatgtttaccacaatgtataatataagaaacaatttgggtctaggagatgataaacta
actattgaagccattgaaaactatttcttggatcctaacaatgaagttatgcctcttattattaataatacggatatgactgccgtcattcctaa
aaaaagtggtaggagaaagaataagaacatggttatcttccgtcaaggatcatcacctatcttgtgtattttcgaaactcgtaaaaagatta
atatttataaagaaaatatggaatccgcgtcgactgagtatacacctatcggagacaacaaggctttgatatctaaatatgcgggaattaat
gtcctgaatgtgtattctccttccacatccatgagattgaatgccatttacggattcaccaataaaaataaactagagaaacttagtactaat

FIG. 12T aaggaactagaatcgtatagttctagccctcttcaagaacccattaggttaaatgattttctgggactattggaatgtgttaaaaagaatattc
ctctaacagatattccgacaaaggattgattactataaatggagaatgttcctaatgtatactttaatcctgtgtttatagagcccacgtttaa
acattctttattaagtgtttataaacacagattaatagttttatttgaagtattcgttgtattcattctaatatatgtattttttagatctgaattaaa
tatgttctttatgcctaaacgaaaaatacccgatcctattgatagattacgacgtgctaatctagcgtgtgaagacgataaattaatgatctat
ggattaccatggatgacaactcaaacatctgcgttatcaataaatagtaaaccgatagtgtataaagattgtgcaaagcttttgcgatcaat
aaatggatcacaaccagtatctcttaacgatgttcttcgcagatgatgattcattttttaagtatttggctagtcaagatgatgaatcttcattat
ctgatatattgcaaatcactcaatatctagactttctgttattattattgatccaatcaaaaaataaattagaagccgtgggtcattgttatgaa
tctctttcagaggaatacagacaattgacaaaattcacagactttcaagattttaaaaaactgtttaacaaggtccctattgttacagatgga
agggtcaaacttaataaaggatatttgttcgactttgtgattagtttgatgcgattcaaaaaagaatcctctctagctaccaccgcaatagatc
ctattagatacatagatcctcgtcgtgatatcgcattttctaacgtgatggatatattaaagtcgaataaagtgaacaataattaattctttatt
gtcatcatgaacggcggaacatattcagttgataatcggccccatgttttcaggtaaaagtacagaattaattagacgagttaaacattatcg
    12R                                                                                                    [del]
gatagctcaatatagatgcatgactatagggtattctagcgatagtagatacggaacaggactatggacgca
tgataaggaataattttgaggcattggaggcaactaggctatgcgatgttttgggattaattacagattctccgt
gataggtatcgatgaaggacagttctttccagacattgttgaattctgtgagcgtatagcaaacgaagggaaa
aatagttatagtagccgcactcgatgaggacatttcaacgtagaccgtttagtaatatttgggtcttgttccatta
tctgaaatggtggtaaaactaactgctgtgtgtatgggatgcttaaggagggcttccttttctagacgattgggt
gaggaaaccgaggtagggaatgatggagggtaatgatatgtatcaatcggtgtgtagaaagtgttacatcgactcataatattat
attttttatctaaaaaactaaaaataaacattgattaaattttaatataatacttaaaaatggatgttgtgtcgttagataaaccgtttatgtatt
ttgaggaaattgataatgagttagattacgaaccagaaagtgcaaatgaggtcgcaaaaaaactgccgtatcaaggacagttaaaactat
tactaggagaattatttttcttagtaagttacagcgacacggtatattagatggtgccaccgtagtgtatataggatctgctcccggtacaca
tatacgttatttgagagatcatttctataatttaggagtgatcatcaaatggatgctaattgacggccgccatcatgatcctattttaaatggat
tgcgtgatgtgactctagtgactcggttcgttgatgaggaatatctacgatccatcaaaaaacaactgcatccttctaagattattttaatttct
gatgtgagatccaaacgaggaggaaatgaacctagtacggcggatttactaagtaattacgctctacaaaatgtcatgattagtattttaaa
ccccgtggcgtctagtcttaaatggagatgcccgtttccagatcaatggatcaaggactttatatcccacacggtaataaaatgttacaacc
ttttgctccttcatattcagctgaaatgagattattaagtatttataccggtgagaacatgagactgactcgagttaccaaattagacgctgta
aattatgaaaaaaagatgtactaccttaataagatcgtccgtaacaaagtagttgttaactttgattatcctaatcaggaatatgactattttc
acatgtactttatgctgaggaccgtgtactgcaataaaacatttcctactactaaagcaaaggtactatttctacaacaatctatatttcgtttc
ttaaatattccaacaacatcaactgaaaaagttagtcatgaaccaatacaacgtaaaatatctagcaaaaattctatgtctaaaaacagaa
atagcaagagatccgtacgcGgtaataaatagaaacgtGctactgagatatactaccgatatagagtataatgatttagttactttaataa
ccgttagacataaaattgattctatgaaaactgtgtttcaggtatttaacgaatcatccataaattatactccggttgatgatgattatggaga
accaatcattataacatcgtatcttcaaaaaggtcataacaagtttcctgtaaatttctatacatagatgtggtaatatctgacttatttccta
gctttgttagactagatactacagaaactaatatagttaatagtgtactacaaacaggTgatggtaaaaagactcttcgtcttcccaaaatgt
tagagacggaaatagttgtcaagattctctatcgccctaatataccattaaaaattgttagattttttccgcaataacatggtaactggagtag
agatagccgatagatctgttatttcagtcgctgattaatcaattagtagagatgagataagaacattataataatcaataatatatcttatatc
ttatatcttatatcttatatcttgtttagaaaaatgctaatattaaaatagctaacgctagtaatccaatcggaagccatttgatatctataata
gggtatctcaatttcctgatttaaatagcggacagctatattctcggtagctactcgtttggaatcacaaacattatttacatctaatttactatct
gtaatggaaacgtttcccaatgaaatggtacaatccgatacattgcattttgttatattttttttttaaagaggctggtaacaacgcatcgcttcg
tttacatggctcgtaccaacaataatagggtaatcttgtatctattcctatccgtactatgcttttatcaggataaatacatttacatcgtatatc
gtctttgttagcatcacagaatgcataaatttgttcgtccgtcatgataaaaatttaaagtgtaaatataactattattttatagttgtaataaa
aagggaaatttgattgtatactttcggttctttaaaagaaactgacttgataaaaatggctgtaatctctaaggttacgtatagtctatatgat
caaaaagagattaatgctacagatattatcattagtcatgttaaaaatgacgacgatatcggtaccgttaaagatggtagactaggtgctat

FIG. 12U ggatggggcattatgtaaAacttgtgggaaaacggaattggaatgtttcggtcactggggtaaagtaagtatttataaaactcatatagtta agcctgaatttatttcagaaattattcgtttactgaatcatatatgtattcactgcggattattgcgttcacgagaaccgtattccgacgatatta acctaaaagagttatcgggacacgctcttaggagattaaaggataaaatattatccaagaaaaagtcatgttggaacagcgaatgtatgc aaccgtatcaaaaaattacttttcaaagaaaaaggtttgtttcgtcaacaagttggatgatattaacgttcctaattctctcatctatcaaaa gttaatttctattcatgaaaagttttggccattattagaaattcatcaatatccagctaacttattttatacagactactttcccatccctccgCtg attattagaccggctattagttttggatagatagtatacccaaagaAaccaatgaattaacttacttattaggtatgatcgttaagaattgta acttgaatgctgatgaacaggttatccagaaggcggtaatagaatacgatgatattaaaattatttctaataacactaccagtatcaatttat catatatcacatccggcaaaaataatatgattagaagttatatcgtcgcccggcgaaaagatcagaccgctagatctgtaattggtcccagt acatctatcaccgttaatgaggtaggaatgcccgcatatattagaaatacacttacagaaaagatatttgttaatgcctttacagtggataaa gttaaacaactattagcgtcaaaccaagttaaattttactttaataaacgattaaaccaattaacaagaatacgccaaggaaagtttatcaa aaataaaatacatttattgcctggtgattgggtagaagtagctgttcaagaatatacaagtattattttttggaagacagccgtctctacatag atacaacgtcatcgcttcatctatcagagctaccgaaggagatactatcaaaatatctcccggaattgccaactctcaaaatgctgatttcga cggggatgaggaatggatgatattagaacaaaatcctaaagctgtaattgaacaaagtattcttatgtatccgacgacgttactcaaacac gatattcatggagcccccgtttatggatctattcaagatgaaatcgtagcagcgtattcattgtttaggatacaagatctttgtttagatgaagt attgaacatcttggggaaatatggaagagagttcgatcctaaaggtaaatgtaaattcagcggtaaagatatctatacttacttgataggtg aaaagattaattatccgggtctcttaaaggatggtgaaattattgcaaacgacgtagatagtaattttgttgtggctatgaggcatctgtcatt ggctggactcttatccgatcataagtcgaacgtggaaggtatcaactttattatcaagtcatcttatgtttttaagagatatctatctatttacg gttttggggtgacattcaaagatctgagaccaaattcgacgttcactaataaattggaggccatcaacgtagaaaaaatagaacttatcaa agaagcatacgccaaatatctcaacgatgtaagagacgggaaaatagttccattatctaaagctttagaggcggactatgtggaatccatg ttatccaacttgacaaatcttaatatccgagagatagaagaacatatgagacaaacgctgatagatgatccagataataacctcctgaaaa tggccaaagcgggttataaagtaaatcctacagaactaatgtatattctaggtacgtatggacaacaaaggattgatggtgaaccagcag agactcgagtattgggtagagtcttaccttactatcttccagactctaaggatccagaaggaagaggttacattcttaattctttaacaaaag gattaacgggttctcaatattacttttcgatgctggttgcaagatctcaatctactgatatcgtctgtgaaacatcacgtaccggaacactggc tagaaaaatcattaaaaagatggaggatatggtggtcgacggatacggacaagtagttataggtaatacgctcatcaagtacgccgccaa ttataccaaaattctaggctcagtatgtaaacctgtagatcttatctatccagatgagtccatgacttggtatttggaaattagtgctctgtgga ataaaataaaacagggattcgtttactctcagaaacagaaacttgcaaagaagacattggcgccgtttaatttcctagtattcgtcaaaccc accactgaggataatgctattaaggttaaggatctgtacgatatgattcataacgtcattgatgatgtgagagagaaatacttctttacggta tctaatatagatttatggagtatatattcttgacgcatcttaatccttctagaattagaattacaaaagaaacggctatcactatctttgaaaa gttctatgaaaaactcaattatactctaggtggtggaactcctattggaattatttctgcacaggtattgtctgagaagtttacacaacaagcc ctgtccagttttcacactactgaaaaaaagtggtgccgtcaaacaaaaacttggtttcaacgagtttaataacttgactaatttgagtaagaat aagaccgaaattatcactctggtatccgatgatatctctaaacttcaatctgttaagattaatttcgaatttgtatgtttgggagaattaaatcc agacatcactcttcgaaaagaaacagataggtatgtagtagatataatagtcaatagattatacatcaagagagcagaaattaccgaatta gtcgtcgaatatatgattgaacgatttatctcctttagcgtcattgtaaaggaatggggtatggaaacattcattgaggatgaggataatatta gatttactgtctacctaaatttcgttgaaccggaagaattgaatcttagtaagtttatgatggttcttccgggtgccgccaacaagggcaagat tagtaaattcaagattcctatctctgactatacgggatatgacgacttcaatcaaacaaaaaagctcaataagatgactgtagaactcatga atctaaaagaattgggttctttcgatttggaaaacgtcaacgtgtatcctggagtatggaatacatacgatatcttcggtatcgaggccgctc gtgaatacttgtgcgaagccatgttaaacacctatggagaagggttcgattatctgtatcagccttgtgatcttctcgctagtttactatgtgct agttacgaaccagaatcagtgaataaattcaagttcggcgcagctagtactcttaagagagctacgttcggagacaataaagcattgttaa acgcggctcttcataaaaagtcagaacctattaacgataatagtagctgccacttttttagcaaggtccctaatataggaactggatattaca aatactttatcgacttgggtcttctcatgagaatggaaaggaaactatctgataagatatcttctcaaaagatcaaggaaatggaagaaac agaagactttttaattcttatcaataacatattttttctatgatctgtcttttaaacgatggattttccacaaatgcgcctctcaagtccctcataga atgatacacgtataaaaaatatagcataggcaatgactccttattttttagacattagatatgccaaaatcatagccccgcttcatttactccc gcagcacaatgaaccaacacgggctcgtttcgttgatcacatttagataaaaaggcggttacgtcgtcaaaatatttactaatatcggtagtt gtatcatctaccaacggtatatgaataatattaatattagagttaggtaatgtatatttatccatcgtcaaatttaaaacatatttgaacttaac

FIG. 12V ttcagatgatggtgcatccatagcattttttataatttcccaaatacacattattggttacccttgtcattatagtgggagatttggctctgtgcat
atctccagttgaacgtagtagtaagtatttatacaaacttttcttatccatttataacgtacaaatggataaaactactttatcggtaaacgcgt
gtaatttagaatacgttagagaaaaggctatagtaggcgtacaagcagccaaaacatcaacacttatattctttgttattatattggcaatta
gtgcgctattactctggtttcagacgtctgataatccagtctttaatgaattaacgagatatatgcgaattaaaaatacggttaacgattggaa
atcattaacggatagcaaaacaaaattagaaagtgatagaggtagacttctagccgctggtaaggatgatatattcgaattcaaatgtgtg
gatttcggcgcctattttatagctatgcgattggataagaaaacatatctgccgcaagctattaggcgaggtactggagacgcgtggatggt
taaaaaggcggcaaaggtcgatccatctgctcaacaattttgtcagtatttgataaaacacaagtctaataatgttattacttgtggtaatga
gatgttaaatgaattaggttatagcggttattttatgtcaccgcattggtgttccgattttagtaatatggaatagtgttagataaatgcggtaa
cgaatgttcctgtaaggaaccataacagtttagatttaacgttaaagatgagcataaacataataaacaaaattacaatcaaacctataac
attaatatcaaacaatccaaaaaatgaaatcagtggagtagtaaacgcgtacataactcctggataacgtttagtagctgccgttcctattc
tagaccaaaaattcggtttcatgtttcgaaacggtgttctgcaacaagtcggggatcgtgttctacatatttggcggcattatccagtatctg
cctattgatcttcatttcgttttcaattctggctatttcaaaataaaatcccgatgatagacctccagactttataatttcatctacgatgttcagc
gccgtagtaactctaataatataggctgataagctaacatcataccctcctgtatatgtgaatatggcatgattttttgtccattacaagctcgg
ttttaactttattgcctgtaataatttctctcatctgtaggatatctatttttttttgtcatgcattgccttcaagacgggacgaagaaacgtaatatc
ctcaataacgttatcgttttctacaataactacatattctacctttttattttctaactcggtaaaaaaattagaatcccatagggctaaatgtct
agcgatatttcttttcgtttcctctgtacacatagtgttacaaaaccctgaaaagaagtgagtatacttgtcatcatttctaatgtttcctccagt
ccactgtataaacgcataatccttgtaatgatctggatcatccttgactaccacaacatttcttttttctggcataacttcgttgtcctttacatca
tcgaacttctgatcattaatatgctcatgaacattaggaaatgtttctgatggaagtctatcaataactggcacaacaataacaggagttttc
gccgccgccatttagttattgaaattaatcatatacaactctttaatacgagttatattttcgtctatccattgtttcacatttacatatttcgaca
aaaagatataaaatgcgtattccaatgcttctctgtttaatgaattactaaaatatacaaacacgtcactgtctggcaataaatgatatctta
gaatattgtaacaatttattttgtattgcacatgttcgtgatctatgagttcttcttcgaatggcataggatctccgaatctgaaaacgtataaat
aggagttagaataataatatttgagagtattggtaatatataaactctttagcggtataattagtttttttctctcaatttctatttttagatgtga
tggaaaaatgactaattttgtagcattagtatcatgaactctaatcaaaatcttaatatcttcgtcacacgttagctctttgaagttttttaagag
atgcatcagttggttcgaccgatggagtaggtgcaacaatttttttgttcgatgtatgtatgtactggagccattgtttttaactataatggtgcttg
tatcgaaaaactttaatgcagatagcggaagctcttcgccgcgactttctacatcgtaattgggttctaacgccgatctctgaatggatacta
gttttctaagttctaatgtgattctctgaaaatgtaaatccaattcctccggcattatagatgtgtatacatcggtaaataaaactatagtatcc
aacgatcccttctcgcaaattctagtcttaaccaaaaaatcgtatataaccacggagatggcgtatttaagagtggattccttctaccgtttttgtt
cttggatgtcatataggaaactataaagtccgcactactgttaagaatgattactaacgcaactatatagttcaaattaagcattttggaaac
ataaaataactctgtagacgatacttgactttcgaataagtttgcagacaaacgaagaaagaacagacctctcttaatttcagaagaaac
ttttttcgtattcctgacgtctagagtttatatcaataagaaagttaagaattagtcggttaatgttgtatttcattacccaagtttgagatttcat
aatattatcaaaagacatgataatattaaagataaagcgctgactatgaacgaaatagctatatggttcgctcaaaaatatagtcttgttaa
acgtggaaacgataactgtatttttaatcacgtcagcggcatctcaaattaaatataggtatatttattccacacactctacaatatgccacac
catcttcataataaataaattcgttagcaaaattattaattttagtgaaatagttagcgtcaactttcatagcttccttcaatctaatttgatgct
cacacggtgcgaattccactctaacatcccttttccatgcctcaggttcatcgatctctataatatctagttttttgcgtttcacaaacacaggct
cgtctctcgcgatgagatctgtatagtaactatgtaaatgataactagatagaaagatgtagctatatagatgacgatcctttaagagaggt
ataataactttacccccaatcagatagactgttgttatggtcttcggaaaaagaattttttataaattttttccagtattttccaaatatacgtactta
acatctaaaaaatccttaatgataataggaatggataatccgtcgtattttataaagaaatacatatcgcacattatacttttttttttggaaatgg
gaataccgatgtgtctacataaatatgcaaagtctaaatatttttttagagaatcttaattggtccaaattcttttccaagtacggtaatagattt
ttcatattgaacggtatcttcttaatctctggttctagttccgcattaaatgatgaaactaagtcactatttttataactaacgattacatcacct
ctaacatcatcatttaccagaatactgatcttcttttgtcgtaaatacatgtctaatgtgttaaaaaaaagatcatacaagttatacgtcatttc
atctgtggtattcttgtcattgaaggataaactcgtactaatctcttctttaacagcctgttcaaatttatatcctatatacgaaaaaatagcaa
ccagtgtttgatcatccgcgtcaatattctgttctatcgtagtgtataacaatcgtatatcttcttctgtgatagtcgatacgttataaaggttgat
aacgaaaatattttttatttcgtgaaataaagtcatcgtaggattttggacttatattcgcgtctagtagatatgctttttattttttggaatgatctca
attagaatagtctcttttagagtccatttaaagttacaaacaactaggaaattggtttatgatgtataattttttttttagtttttatagattctttattct

FIG. 12W atacttaaaaaatgaaaataaatacaaaggttcttgagggttgtgttaaattgaaagcgagaaataatcataaattatttcattatcgcgata
tccgttaagtttgtatcgtaatggcgtggtcaattacgaataaagcggatactagtagcttcacaaagatggctgaaatcagagctcatcta
aaaaatagcgctgaaaataaagataaaaacgaggatattttcccggaagatgtaataattccatctactaagcccaaaaccaaacgagc
cactactcctcgtaaaccagcggctactaaaagatcaaccaaaaaggaggaagtggaagaagaagtagttatagaggaatatcatcaaa
caactgaaaaaaattctccatctcctggagtcagcgacattgtagaaagcgtggccgctgtagagctcgatgatagcgacggggatgatg
aacctatggtacaagttgaagctggtaaagtaaatcatagtgctagaagcgatctttctgacctaaaggtggctaccgacaatatcgttaaa
gatcttaagaaaattattactagaatctctgcagtatcgacggttctagaggatgttcaagcagctggtatctctagacaatttacttctatga
ctaaagctattacaacactatctgatctagtcaccgagggaaaatctaaagttgttcgtaaaaaagttaaaacttgtaagaagtaaatgcgt
gcacttttttataaagatggtaaactctttaccgataataattttttaaatcctgtatcagacgataatccagcgtatgaggttttgcaacatgtt
aaaattcctactcatttaacagatgtagtagtatatgaacaaacgtgggaggaggcgttaactagattaattttttgtgggaagcgattcaaa
aggacgtagacaatactttacggaaaaatgcatgtacagaatcgcaacgctaaaagagatcgtattttttgttagagtatataacgttatga
aacgaattaattgttttataaacaaaaatataaagaaatcgtccacagattccaattatcagttggcggttttttatgttaatggaaactatgttt
tttattagatttggtaaaatgaaatatcttaaggagaatgaaacagtagggttattaacactaaaaaataaacacatagaaataagtcccg
atgaaatagttatcaagtttgtaggaaaggacaaagtttcacatgaatttgttgttcataagtctaatagactatataaaaccgctattgaaac
tgacggatgattctagtcccgaagaatttctgttcaacaaactaagtgaacgaaaggtatacgaatgtatcaaacagtttggtattagaatc
aaggatctccgaacgtatggagtcaattatacgttttttatataattttttggacaaatgtaaagtccatatctcctcttccatcaccaaaaaagtt
aatagcgttaactatcaaacaaactgctgaagtggtaggtcatactccatcaatttcaaaaagagcttacatggcaacgactattttagaaa
tggtaaaggataaaaattttttagatgtagtatctaaaactacgttcgatgaattcctatctatagtcgtagatcacgttaaatcatctacgga
tggatgatatagatctttacacaaataattacaagaccgatattaaatggaaatggataagcgtatgaaatctctcgcaatgaccgcttctttg
gggagctaagcacattagatattatggcattgataatgtctatatttaaacgccatccaaacaataccatttttttcagtggataaggatggtc
agtttatgattgatttcgaatacgataattataaggcttctcaatatttggatctgaccctcactccgatatttggagatgaatgcaagactcac
gcatcgagtatagccgaacaattggcgtgtgcggatattattaaagaggatattagcgaatacatcaaaactactccccgtcttaaacgatt
tataaaaaaaataccgcaatagatcagatactcgcatcagtcgagatacagaaaagcttaaaatagctctagctaaaggcatagattacga
atatatataaaagacgcttgttaataagtaaatgaaaaaaaaactagtcgtttataataaaacacaatatggatgccaacatagtatcatcttct
actattgcaacgtatatagacgctttagcgaagaatgcttcagaattagaacagaggtctaccgcatacgaaataaataatgaattggaac
tagtatttattaagccgccattaattactttgacaaatgtagtgaatatctctacgattcaggaatcgtttattcgatttaccgttactaataagg
aaggtgttaaaattagaactaagattccattatctaaggtacatggtctagatgtaaaaaatgtacagttagtagatgctatagataacata
gtttgggaaaagaaatcattagtgacggaaaatcgtcttcacaaagaatgcttgttgagactatcgacagaggaacgtcatatattttttgga
ttacaagaaatatggatcctctatccgactagaattagtcaatcttattcaagcaaaaacaaaaaactttacgatagactttaagctaaaat
attttctaggatccggtgcccaatctaaaagttctttgttgcacgctattaatcatccaaagtcaaggcctaatacatctctggaaatagaatt
cacacctagagacaatgaaaaagttccatatgatgaactaataaaggaattgacgactctatcacgtcatatatttatggcttctccagaga
atgtaattctttctccgccattaacgcacctataaagactttatgttgcctaaacaagatatagtaggtctggatctggaaaatctatatgcc
gtaactaagactgacggcattcctataactatcagagttacatcaaacgggttgtattgttattttacacatcttggttatattattagatatcct
gttaagagaataatagattccgaagtagtagtctttggtgaggcagttaaggataagaactggaccgtatatctcattaagctaatagagcc
tgtgaatgcaatcaatgatagactagaagaaagtaagtatgttgaatctaaactagtggatatttgtgatcggatagtattcaagtcaaaga
aatatgaaggtccgtttactacaactagtgaagtcgtcgatatgttatctacatatttaccaaagcaaccagaaggtgttattctgttctattca
aagggacctaaatctaacattgattttaaaattaaaaaggaaaatactatagaccaaactgcaaatgtagtatttaggtacatgtccagtg
aaccaattatctttggagaatcgtctatctttgtagagtataagaaatttagcaacgataaaggctttcctaaagaatatggttctggtaagat
tgtgttatataacggcgttaattatctcaaataatatctcattgtttggaatatattaatacacataatgaagtgggtattaagtccgtggttgtac
ctattaagtttatagcagaattcttagttaatggagaaatacttaaacctagaattgataaaaccatgaaatatattaactcagaagattatt
atggaaatcaacataatatcatagttgaacatttaagagatcaaagcatcaaaataggagatatctttaacgaggataaactatcggatgt
gggacatcaatacgccaataatgataaatttagattaaatccagaagttagttattttacgaataaacgaactagaggaccgttgggaattt
tatcaaactacgtcaagactcttcttatttctatgtattgttccaaaacattttttagacgattccaacaaacgaaaggtattggcgattgattttg
gaaacggtgctgacctggaaaaaatactttatgggagagattgcgttattggtagcgacggatccggatgctgatgctatagctagaggaaa

FIG. 12X tgaaagatacaacaaattaaactctggaattaaaaccaagtactacaaatttgactacattcaggaaactattcgatccgatacatttgtct
ctagtgtcagagaagtattctattttggaaagtttaatatcatcgactggcagtttgctatccattattcttttcatccgagacattatgctaccg
tcatgaataacttatccgaactaactgcttctggaggcaaggtattaatcactaccatggacggagacaaattatcaaaattaacagataa
aaagacttttataattcataagaatttacctagtagcgaaaactatatgtctgtagaaaaaatagctgatgatagaatagtggtatataatcc
atcaacaatgtctactccaatgactgaatacattatcaaaaagaacgatatagtcagagtgtttaacgaatacggatttgttcttgtagataa
cgttgatttcgctacaattatagaacgaagtaaaaagtttattaatggcgcatctacaatggaagatagaccgtctacaaaaaacttttttcga
actaaatagaggagccattaaatgtgaaggtttagatgtcgaagacttacttagttactatgttgtttatgtcttttctaagcggtaaataata
atatggtatgggttctgatatccccgttctaaatgcattaaataattccaatagagcgattttttgttcctataggaccttccaactgtggatact
ctgtattgttaatagatatattaatacttttgtcgggtaacagaggttctacgtcttctaaaaataaaagtttgataacatctggcctgttcata
aataaaaacttggcgattctatatatactcttattatcaaatctagccattgtcttatagatgtgagctactgtaggtgtaccatttgattttcttt
ctaatactatatatttctctcgaagaagttcttgcacatcatctgggaataaaatactactgttgagtaaatcagttattttttttatatcgatatt
gatggacattttatagttaaggataataagtatcccaaagtagataacgacgataacgaagtatttatactttttaggaaatcacaatgactt
tatcagatcaaaattaacaaaattaaaggagcatgtatttttttctgaatatattgtgactccagataaatatggatctttatgcgtcgaattaa
atgggtctagttttcagcacggcggtagatatatagaggtggaggaatttatagatgctggaagacaagttagatggtgttctacatccaat
catatatctgaagatatacccgaagatatacacactgataaatttgtcatttatgatatatacacttttgacgctttcaagaataaacgattgg
tattcgtacaggtacctccgtcgttaggagatgatagctatttgactaatccgttattgtctccgtattatcgtaattcagtagccagacaaatg
gtcaatgatatgattttaatcaagattcatttttaaaatatttattagaacatctgattagaagccactatagagtttctaaacatataacaat
agttagatacaaggataccgaagaattaaatctaacgagaatatgttataatagagataagtttaaggcgtttgtattcgcttggtttaacgg
cgtttcggaaaatgaaaaggtactagatacgtataaaaaggtatctaatttgatataatgaattcagtgactgtatcacacgcgccatatac
tattacttatcacgatgattgggaaccagtaatgagtcaattggtagagtttttataacgaagtagccagttggctgctacgagacgagacgtc
gcctattcctgataagttctttatacagttgaaacaaccgcttagaaataaacgagtatgtgtgtgcggtatagatccgtatccgaaagatgg
aactggtgtaccgttcgaatcaccaaattttacaaaaaaatcaattaaggagatagcttcatctatatctagattaaccggagtaattgatta
taaaggttataaccttaatataatagacggggttataccctggaattattacttaagttgtaaattaggagaaacaaaaagtcacgcgatct
actgggataagatttccaagttactgctgcagcatataactaaacacgttagtgttctttattgtttgggtaaaacagatttctcgaatatacg
ggccaagttagaatccccggtaactaccatagtcggatatcatccagcggctagagaccgccaattcgagaaagatagatcatttgaaatt
atcaacgtttactggaattagacaacaaggcacctataaattgggctcaagggtttatttattaatgctttagtgaaattttaacttgtgttct
aaatggatgcggctattagaggtaatgatgttatctttgttcttaagactataggtgtcccgtcagcgtgcagacaaaatgaagatccaagat
ttgtagaagcatttaaatgcgacgagttagaaagatatattgagaataatccagaatgtacactattcgaaagtcttagggatgaggaagc
atactctatagtcagaattttcatggatgtagatttagacgcgtgtctagacgaaatagattatttaacggctattcaagattttattatcgagg
tgtcaaactgtgtagctagattcgcgtttacagaatgcggcgccattcatgaaaatgtaataaaatccatgagatctaattttttcattgactaa
gtctacaaatagagataaaacaagttttcatattatcttttttagacacgtataccactatggatacattgatagctatgaaacgaacactatta
gaattaagtagatcatctgaaaatccactaacaagatcgatagacactgccgtatataggagaaaaacaactcttcgggttgtaggtacta
ggaaaaatccaaattgcgacactattcatgtaatgcaaccaccgcatgataatatagaagattacctattcacttacgtggatatgaacaac
aatagttattacttttctctacaacaacgattggaggatttagttcctgataagttatgggaaccagggtttatttcattcgaagacgctataaa
aagagtttcaaaaatattcattaattctataataaactttaatgatctcgatgaaaataattttacaacggtaccactggtcatagattacgta
acaccttgtgcattatgtaaaaaacgatcgcataaacatccgcatcaactatcgttggaaaatggtgctattagaatttacaaaactggtaa
tccacatagttgtaaagttaaaattgttccgttagatggtaataaactgtttaatattgcacaaagaatttttagacactaactctgttttattaa
ccgaacgaggagaccatatagtttggattaataattcatggaaatttaacagcgaagaacccttgataacaaaactaattttgtcaataaga
catcaactacctaaggaatattcaagcgaattactctgtccaagaaaacgaaagactgtagaagctaacatacgagacatgttagtagatt
cagtagagaccgatacctatccggataaacttccgtttaaaaatggtgtattggacctggtagacggaatgtttttactctggagatgatgcta
aaaaatatacgtgtactgtatcaaccggatttaaatttgacgatacaaagttcgtcgaagacagtccagaaatggaagagttaatgaatat
cattaacgatatccaaccattaacggatgaaaataagaaaaatagagagctatatgaaaaaacattatctagttgtttatgtggtgctacca
aaggatgtttaacattctttttttggagaaactgcaactggaaagtcgacaaccaaacgtttgttaaagtctgctatcggtgacctgtttgttga
gacgggtcaaacaattttaacagatgtattggataaaggacctaatccatttatcgctaacatgcatttgaaaagatctgtattctgtagcga

FIG. 12Y actacctgattttgcctgtagtggatcaaagaaaattagatctgacaatattaaaaagttgacagaaccttgtgtcattggaagaccgtgttt
ctccaataaaattaataatagaaaccatgcgacaatcattatcgatactaattacaaacctgtttttgataggatagataacgcattaatgag
aagaattgccgtcgtgcgattcagaacacactttctcaaccttctggtagagaggctgctgaaaataatgacgcgtacgataaagtcaaac
tattagacgaggggttagatggtaaaatacaaaataatagatatagattcgcatttctatacttgttggtgaaatggtacagaaaatatcat
gttcctattatgaaactatatcctacaccggaagagattccggactttgcattctatctcaaaataggtactctgttagtatctagctctgtaaa
gcatattccattaatgacggacctctccaaaaagggatatatattgtacgataatgtggtcactcttccgttgactactttccaacagaaaat
atccaagtattttaattctagactatttggacacgatatagagagcttcatcaatagacataagaaatttgccaatgttagtgatgaatatctg
caatatatattcatagaggatatttcatctccgtaaatatatgctcatatatttatagaagatatcacatatctaaatgaataccggaatcata
gatttatttgataatcatgttgatagtataccaactatattacctcatcagttagctactctagattatctagttagaactatcatagatgagaa
cagaagcgtgttattgttccatattatgggatcaggtaaaacaataatcgctttgttgttcgccttggtagcttccagatttaaaaaggtttaca
ttctagtgcctaatatcaacattttgaaaatttttaattataatatgggtgtagctatgaacttgtttaatgacgaattcatagctgagaatatct
ttattcattccacaacaagtttttattctcttaattataacgataacgtcattaattataacggattatctcgctacaataactctattttatcgtt
gatgaggcacataatatctttgggaataatactggagaacttatgaccgtgataaaaaataaaaacaagattccttttctactattgtctgga
tctcccattactaacacacctaatactctgggtcatattatagatttaatgtccgaagagacgatagattttggtgagattattagtcgtggta
agaaagtaattcagacacttcttaacgaacgcggtgtgaatgtacttaaggatttgcttaaaggaagaatatcatattacgaaatgcctgat
aaagatctaccaacgataagatatcacggacgtaagtttctagatactagagtagtatattgtcacatgtctaaacttcaagagagagatta
tatgattactagacgacagctatgttatcatgaaatgtttgataaaaatatgtataacgtgtcaatggcagtattgggacaacttaatctgat
gaataatttagatactttatttcaggaacaggataaggaattgtacccaaatctgaaaataaataatggcgtgttatacggagaagaattgg
taacgttaaacattagttccaaatttaaatactttattaatcggatacagacactcaacggaaaacattttatatactttctaattctacatat
ggtggattggtaattaaatatatcatgctcagtaatggatattctgaatataatggttctcagggaactaatccacatatgataaacggcaa
accaaaaacatttgctatcgttactagtaaaatgaaatcgtctttagaggatctattagatgtgtataattctcctgaaaacgatgatggcag
tcaattgatgttttgttttcatcaaacattatgtccgaatcctatactctaaaagaggtaaggcatatttggtttatgactatcccagatacttt
tctcaatacaaccaaattcttggacgatcattagaaaattctcttacgccgatatttctgaaccagttaatgtatatcttttagccgccgtatat
tccgatttcaatgacgaagtaacgtcattaaacgattacacacaggatgaattgattaatgtttaccatttgacatcaaaaagctgttgtatc
taaaatttaagacgaaagaaacgaatagaatatactctattcttcaagagatgtctgaaacgtattctcttccaccacatccatcaattgtaa
aagtttattgggagaattggtcagacaattttttttataataattctcgtattaagtataacgactccaagttacttaaaatggttacatcagtta
taaaaaataaagaagacgctaggaattacatagatgatattgtaaacggtcacttctttgtatcgaataaagtatttgataaatctcttttata
caaatacgaaaacgatattattacagtaccgtttagactttcctacgaaccatttgtttggggagttaactttcgtaaagaatataacgtggta
tcttctccataaaactgatgaaatatataaagaaataaatgtcgagctttgttaccaatggataccttccagttacattggaaccacacgagc
tgacgttagacataaaaactaatattaggaatgccgtatataagacgtatctccatagagaaattagtggtaaaatggccaagaaaatag
aaattcgtgaagacgtggaattacctctcggcgaaatagttaataattctgtagttataaacgttccgtgtgtaataacctacgcgtattatca
cgttggggatatagtcagaggaacattaaacatcgaagatgaatcaaatgtaactattcaatgtggagatttaatctgtaaactaagtaga
gattcgggtactgtatcatttagcgattcaaagtactgcttttttcgaaatggtaatgcgtatgacaatggcagcgaagtcactgccgttctaa
tggaggctcaacaaggtatcgaatctagttttgttttttctcgcgaatatcgtcgactcataaaaaagagaatagcggtaagtataaacacga
atactatggcaataattgcgaatgtttattctcttcgatatattttgataatatgaaaaacatgtctctctcaaatcggacaaccatctcata
aaatagttctcgcgcgctggagaggtagttgctgctcgtataatctccccagaataatatacttgcgtgtcgtcgttcaatttatacggatttct
atagttctctgttatataatgcggttttccatcatgattagacgacgacaatagtgttctgaatttagatagttgatcagaatgaatgtttattgg
cgttggaaaaattatccatacagcgtctgcagagtggttgatagttgttcctagatatgtaaaataatccaacttactaggcagcaaattgtc
tagataaaatactgaatcaaacggtgcagacgtattggcggatctaatggaatccaattgattaactatcttttgaaaatatacatttttatga
tccaatacttgtaagaatatagaaataatgataagtccatcatcgtgttttttttgcctcttcataagaactatatttttttttattccaatgaacaa
gattaatctctccagagtatttgtacacatctatcaagtgattggatccataatcgtcttccttttccccaatatatatgtagtgatgataacacat
attcattggggagaaaccctccacttatatatcctcctttaaaattaatccttactagttttccagtgttctggatagtggttggtttcgactcatt
ataatgtatgtctaacggcttcaatcgcgcgttagaaattgcttttttagtttctatattaataggagatagttgttgcggcatagtaaaaatga
aatgataactgtttaaaaatagctcttagtatgggaattacaatggatgaggaagtgatatttgaaactcctagagaattaatatctattaaa

FIG. 12Z cgaataaaagatattccaagatcaaaagacacgcatgtgtttgctgcgtgtataacaagtgacggatatccgttaataggagctagaagaa
cttcattcgcgttccaggcgatattatctcaacaaaattcagattctatctttagagtatccactaaactattacggtttatgtactacaatgaa
ctaagagaaatctttagacggttgagaaaaggttctatcaacaatatcgatcctcactttgaagagttaatattattgggtggtaaactagat
aaaaaggaatctattaaagattgtttaagaagagaattaaaagaggaaagtgatgaacgtataacagtaaaagaatttggaaatgtaatt
ctaaaacttacaacacgggataaattatttaataaagtatatataagttattgcatggcgtgtttattaatcaatcgttggaggatttatcgca
tactagtatttacaatgtagaaattagaaagattaaatcattaaatgattgtattaacgacgataaatacgaatatctgtcttatatttataata
tgctagttaatagtaaatgaacttttacagatctagtataattagtcagattattaagtataatagacgactagctaagtctattatttgcgag
gatgactctcaaattattacactcacggcattcgttaaccaatgcctatggtgtcataaacgagtatccgtgtccgctattttattaactactga
taacaaaatattagtatgtaacagacgagatagttttctctattctgaaataattagaactagaaacatgtctagaaagaaacgattatttct
gaattattccaattatttgtccaaacaggaaagaagtatactatcgtcattttttctctagatccagctactactgataatgatagaatagatg
ctatttatccgggtggcatacccaaaaggggtgagaatgttccagagtgtttatccagggaaattaaagaagaagttaatatagacaattct
tttgtattcatagacactcggtttttattcatggcatcatagaagataccattattaataaattttttgaggtaatcttctttgtcggaagaatat
ctttaacgagtgatcaaatcattgatacatttaaaagtaatcatgaaatcaaggatctaatattttagatccgaattcaggtaatggactcca
atacgaaattgcaaaatatgctctagatactgcaaaactcaaatgttatggccatagaggatgttattacgaatcattaaaaaaattaactg
aggatgattgattagaaaatataaattaatttaccatcgtgtatttttataacgggattgtccggcatatcatgtagatagttaccgtctacatc
gtatactcgaccatctacgcctttaaatcctctatttattgacattaatctattagaattggaataccaaatattagtaccctcaattagtttatt
ggtaatatttttttttagacgatagatcgatggctcttgaaaccaaggttttccaaccggactcattgtcgatcggtgagaagtctttttcattag
catgaatccattctaatgatgtatgtttaaacactctaaacaattggacaaattctttgatttgctttgaatgatttcaaataggtcttcgtcta
cagtaggcataccattagataatctagccattataaagtgcacgtttacatatctacgttctggaggagtaagaacgtgactattgagacga
atggctcttcctactatctgacgaagagacgcctcgttccatgtcatatctaaaatgaagatatcattaattgagaaaaaactaataccctcg
cctccactagaagagaatacgcatgtttttaatgcattctccgttagtgtttgattcttggttaaactcagccaccgccttgattctagtatcttttg
ttctagatgagaactctatattagagataccaaagactttgaaatatagtaataagatttctattcctgactgattaacaaatggttcaaaga
ctagacatttaccatgggatgctaatattcccaaacatacatctataaatttgacgcttttctcttttaattcagtaaatagagagatatcagcc
gcactagcatcccctttcaatagttctcccttttttaaaggtatctaatgcggatttagaaaactctctatctcttaatgaattttttaaaatcattat
atagtgttgctatctcttgcgcgtattcgcccggatcacgattttgtctttcaggaaagctatcgaacgtaaacgtagtagccatacgtctcag
aattctaaatgatgatatacctgtttttatttcagcgagtttagccttttgataaatttcttcttgcttttttcgacatattaacgtatcgcattaatac
tgtttttcttagcgaatgatgcagacccttctacgtcatcaaaaatagaaaactcgttattaactatgtacgaacataggcctcctagtttggag
actaattctttctcatcaactagacgtttattctcaaatagcgattggtgttgtaaggatcctggtcgtagtaagttaaccaacatggtgaattc
ttgcacactattaacgataggtgtagccgataaacaaatcatcttatggtttttttaatgcgatggtcttagataaaaaattatatactgaacga
gtaggacggatcttaccatcttctttgattaatgatttagaaatgaagttatgacattcatcaataatgacgcatattctactcttggaattaat
agttttgatattagtaaaaaatttatttctaaaattttgatcatcgtaattaataaaaatacaatccttcgttatctctggagcgtatctgagtat
agtgttcatccaaggatcttctatcaaagcctttttcaccaataagataatagcccaattcgtataaatatccttaagatgtttgagaatatata
cagtagtcattgttttaccgacacccgtttcatggaacaataaaagagaatgcatactgtctaatcctaagaaaactcttgctacaaaatgtt
gataatccttgaggcgtactacgtccgaccccatcatttcaacgggcatattagtagttctgcgcaatgcataatcgatataggccgcgtgtg
atttactcatttatgagtgataagtaataactatgttttaaaaatcacagcagtagtttaactagtcttctctgatgtttgttttcgatactttttga
atcagaagtcatactagaataaagcaacgagtgaacgtaatagagagcttcgtatactctattcgaaaactctaagaacttattaatgaatt
ccgtatccactggattgtttaaaatactaaattgaacactgttcacatccttccaagaagaagacttagtgacggacttaacatgagacata
aataaatccaaatttttttttacaaacatcactagccaccataatggcgctatctttcaaccagctatcgcttacgcatttttagcagtctaacatt
tttaaagagactacaatatattctcatagtatcgattacacctctaccgaataaagttggaagtttaataatacaatattttttcgtttacaaaat
caaataatggtcgaaacacgtcgaaggttaacatcttataatcgctaatgtatagattgttttcagtgagatgattattagatttaatagcatc
tcgttcacgtttgaacagtttattgcgtgcgctgaggtcggcaactacggcgtccgctttagtactcctcccataatactttacgctattaatctt
taaaatttcatagactttatctagatcgctttctggtaacatgatatcatgtgtaaaaagtttttaacatgtcggtcggcattctatttagatcatt
aactctagaaatctgaagaaagtaattagctccgtattccagactaggtaatgggcttttacctagagacagattaagttctggcaatgtttc
ataaaatggaagaaggacatgcgttccctcccggatattttttacaatttcatccatttacaactctatagtttgttttcattattattagttattat

FIG. 12AA ctcccataatcttggtaatacttaccccttgatcgtaagataccttatacaggtcattacatacaactaccaattgtttttgtacataatagattg gatggttgacatccatggtggaataaactactcgaacagatagtttatctttccccctagatacattagccgtaatagttgtcggcctaaaga atatctttggtgtaaagttaaaagttagggttcttgttccattattgcttttttgtcagtagttcattatataattctcgagatgggtccgttctctgaa tatagaacatcatttccaaatctaacttctagtctagaaataatatcggtcttattcttaaaatctattcccttgatgaagggatcgttaatgaa caaatccttggcctttgattcggctgatctattatctccgttatagacgttacgttgactagtccaaagacttacaggaatagatgtatcgatga tgttgatactatgtgatatgtgagcaaagattgttctcttagtggcatcactatatgttccagtaatggcggaaaacttttttagaaatgttatat ataaaagaattttttcgtgttccaaacattagcagattagtatgaagataaacactcatattatcaggaacattatcaattttttacatacacat cagcatcttgaatagaaacgataccatcttctggaacctcaacaatctcggcagactccggataaccagtcggtgggccatcactaacaat aactagatcatccaacaatctactcacatatgcatctatataatctttttcatcttgtgagtaccctggatacgaaataaatttattatccgtatt tccataataaggtttagtataaacagagagcgatgttgccgcatgaacttcagttacagtcgccgttggttggtttatttgacctattactctcc taggtttctctataaacgatggtttaatttgtacattcttaaccatatatccaataaagctcaattcaggaacataaacaaattctttgttgaac gtttcaaagtcgaacgaagagtcacgaataacgatatcggatactggattgaaggttaccgttacggtaattttgaatcggatagtttaaga ctgctgaatgtatcttccacatcaaacggagttttaatataaacgtatactgtagatggttctttaatagtgtcattaggagttaggccaatag aaatatcattaagttcactagaatatccagagtgtttcaaagcaattgtattattgatacaattattatataattcttcgccctcaatttcccaaa taacaccgttacacgaagagatagatacgtgattaatacatttatatccaacatatggtacgtaaccgaatcttcccatacctttaacttctgg aagttccaaactcagaaccaaatgattaagcgcagtaatatactgatccctaatttcgaagctagcgatagcctgattgtctggaccatcgtt tgtcataactccggatagagaaatatattgcggcatatatataaagttggaatttgactatcgactgcgaagacattagaccgtttaatagagtc atccccaccgatcaaagaattaatgatagtattattcattttctatttaaaatggaaaaagcttacaataaactccgtagagaaatatctata atttgtgagttttccttaaagtaacagcttccgtaaacgccgtctttatctcttagtaagtttattgtatttataacctttttccttatcttcatagaat actaaaggcaacaaagaaattttttggttcttctctaagagctacgtgagacttaaccatagacgccaacgaatccctacatattttagaaca gaaatacccaacttcaccaccccttgaatgtctcaatactaataggtttaaaaaccaaatcttgattacaaaaccaacacttatcaattacact atttgtcttaatagacacatctgccatagatttataatactttggtagtatacaagcgagtgcttcttcttttagcgggcttaaagactgctttag gtgctgaaataaccacatctggaaggcttactcgcttagccatttaattacggaactatttttttatacttctaatgagcaagtagaaaacctc tcatctacaaaaacatactcgtgtccataatcctctaccatagttacacgttttttagatctcatatgtgctaaaaagttttcccatactaattgg ttactattattttttcgtataattttttaacagtttgaggtttttagattttttagttacagaagtgatatcgaatattttatccaaaaagaatgaataatt aattgtcttagaaggagtgtttttcttggcaaaagaataccaagtgcttaaatatttctactacttcattaatcttttctgtactcagattcagtttc tcatcttttacttgattgattatttcaaagactaacttataatcctttttatttattctctcgttagccttaagaaaactagatacaaaatttgcatc tacatcatccgtggatatttgatttttttccatgatatccaagagttccgagataatttctccagaacattgatgagacaataatctccgcaata catttctcaaatgaataagtttattagacacatggaagtttgacttttttttgtacctttgtacattttttgaaataccgactcgcaaaaaatacaat attcatatccttgttcagatactataccgttgtgtctacaaccgctacataatcgtagattcatgttaacactctacgtatctcgtcgtccaatat tttatataaaaacattttatttctagacgttgccagaaaatcctgtaatattttttagttttttgggctgtgaataaagtatcgccctaatattgtta ccgtcttccgccaatatagtagttaaattatccgcacatgcaaaagaacaccgcttaggcggattcagtacaatgttatatttttcgtaccaac tcatttaaatatcataatctaaaatagttctgtaatatgtctagcgctaatatattgatcataatcctgtgcataaattaagatacaacaatgtc tcgaaatcatcgacatggcttcttccatagttagaagatcgtcgtcaaagttagcaacgtgattcatcaacatttgctgttttgaggcagcaaa tactgaaccgtcgccattcaaccattcataaaaaccatcgtctgaatccattgataatttcttgtactggttttttgagagctcgcatcaatctag catttctagctcccggattgaaaacagaaagaggatcgtacatccagggtccattttctgtaaatagaatcgtataatgtcccttcaagaag atatcagacgatccacaatcaaagaattggtctccgagtttgtaacaaactgcggactttaacctatacatgataccgtttagcatgatttct ggtgatacgtcaatcggagtatcatctattagagatctaaagccggtgtaacattctccaccaaacatattcttattctgacgtcgttctacat aaaacatcattgctccattaacgataacaggggaatgaacagcactacccatcacattagttcccaatggatcaatgtgtgtaactccaga acatcttccatatcctatgttaggaggagcgaacaccactcttccactattgccatcgaatgccatagaataaatatccttggaattgataga aatcggactgtcggatgttgtgatcatcttcataggattaacaactatgtatggtgccgcctgaagtttcatatcgtaactgatgccgtttata ggtctagccacagaaaccaacgtaggtctaaatccaactatagacaaaatagaagccaatatctgttcctcatctgtcataacttgagagc atccagtatgaataatcttcattagatgggggatctaccgcatcatcatcgttacaataaaaaattcccattctaatgttcataattgcttttcta atcatggtatgcatgtttgctctctgaatctctgtggaaattagatctgatacacctgtaatcactatcggattatcctccgtaagacgattaac

FIG. 12AB caacaacatataattataagactttactttctaaattcataaagttgctggattaggctataggtgtctccatgtacatacgcgttctcgagcg caggaagtttaataccgaatagtgccatcagaataggatgaatatagtaattagtttctggttttctataaataaaagacaaatcttgtgaac tagacatatcggtaaaatgcatggattggaatcgtgtagtcgacagaagaatatgatgattagatggagagtatattttatctaactctttga gttggtcaccgattctaggactagctcgagaatgaataagtactaaaggatgagtacatttcacagaaacactagcattgttcaatgtgctct ttacatgggtaaggagttgaaatagctcgtttctatttgttctgacaatatttagtttattcataatgttaagcatatcctgaatagtaaagttag atgtgtcatacttgttagtagttagatatttagcaattgcattcccatcatttctcaatctcgtactccaatcatgtgtagatgctacttcgtcgat ggaaaccatacaatcctttttgataggctgttgagattgattatttcctgcacgtttaggtttggtacgttgatttctagcccctgcagatataaa gtcatcgtctacaattttggataatgaattgcatacactacaagacaaagatttatcagaagtgtgaatatgatcttcatctaccaaagaaag agtttgattagtataactagatttttagtcctgcgttagatgttaaaaaaacatcgctattgaccacggcttccattatttatattcgtagtttttac tcgaaagcgtgattttaatatccaatcttattacttttggaatcgttcaaaacctttgactagttgtagaatttgatctattgccctacgcgtata ctcccttgcatcatatacgttcgtcaccagatcgtttgtttcggcctgaagttggtgcatatctttttcaacactcgacatgagatccttaagggc catatcgtctagattttgttgagatgctgctcctggatttggattttgttgtgctgttgtacatactgtaccaccagtaggtgtaggagtacatac agtggccacaataggaggttgaggaggtgtaaccgttggagtagtacaagaaatacttccatccgattgttgtgtacatgtagttgttggta acgtctgagaaggttgggtagatggcggtgtcgtcgtcttttgatctttattaaatttagagataatatcctgaacagcattgctcggcgtcaa cgctggaaggagtgaactcgccggcgcatcagtatctgcagacagccaatcaaaaagattagacatatcagatgatgtattagtttgttgtc gtggttttggtgtaggagcagtactactaggtagaagaataggagccgatgtaggtgtcggaaccggaaccggctgtggagttatatgaat agttggttgtagcggttggataggctgtctgctggcggccatcatattatctctagctagttgttctcgcaactgtctttgataatacgactcttg agactttagtcctatttcaatcgcttcatcctttttcgtatccggatccttttttttcagaataatagattgacgactttggtgtagaggattctgcc agcccctgtgagaacttgttaaagaagtccatttaaggctttaaaattgaattgcgattataagattaaatggcagacacagacgatattatc gactatgaatccgatgatctcactgaatacgaggatgatgaagaagaggaagaagatggagagtcactagaaactagtgatatagatccc aaatcttcttataagattgtagaatcagcatccactcatatagaagatgcgcattccaatcttaaacatatagggaatcatatatctgctctta aacgacgctatactagacgtataagtctatttgaaatagcgggtataatagcagaaagctataacttgcttcaacgaggaagattacctcta gtttcagaattttctgacgaaacgatgaagcaaaatatgctacatgtaattatacaagagatagaggagggttcttgtcctatagtcatcgaa aagaacggagaattgttgtcggtaaacgattttgacaaagatggtctaaaattccatctagactatattatcaaaatttggaaacttcaaaa acgatattagaatttatacgaatatcgttctctaaatgtcacaatcaagtctcgcatgttcagcaatttattgtcgtactttatatcgtgttcatta acgatatcttgcaaaatagtaatgattctatcttccttcgatagatattcttcagagattattgtcttatattctttcttgttatccgatatgaatttg ataagactttgaacattattaatacccgtctgtttaatttttttctacagatattttagttttggcagattctatcgtatctgtcaatagacatccaa catcgacattcgacgtcaattgtctataaatcaacgtataaattttagaaataacattagcgaattgttgtgcattgatgtcgttattctgaaac agtatgatttttaggtagcatttttcttaacaaagagaacgtatttattgttactcagttgaacagatgatatatccagattactaacgcatctgat tccgtataccaaactttcagaagaaatggtgtacaattgtttgtattcattcaatgtctcctttcagaaattagtttagagtcgaatactgcaa taattttcaagagatagttttcatcagataagatttatttagtgtagatatgataaaactattgttttgttggagaacttgatacgccgcgttctc tgtagtcgacgctctcaaatgggaaacgatctccattatttttttggaatcggatactatatcttcggtatcttgacgcagtctagtatacatag agttaagagagattagagtttgtacattaagcaacatgtctctaaatgtggctacaaacttttcctttttcacatCatctcagtttattatataccg atttcacaacggcaccagatttaaggaaccagaatgaaaaactctgataactacaatatttcatcatagttacgattttatcatcttctatagt tggtgtaatagcgcatacctttttctccaagactggaaccaacgtcataaaaatgtttaaatcaaatccatatcaacatctgatgcgctaag accagtctcgcgttcaagattatctttactaatggtgacgaactcatcgtatagaactctaagtttgtccattatttatttacagatttagttgttt aatttatttgtgctcttccagagttgggatagtattttttctaacgtcggtattatattattaggatctacgttcatatgtatcataatattaatcatc cacgttttgataaatctatctttagcttctgaaataacgtatttaaacaaaggagaaaaatatttagctacggcatcagacgcaataacatttt ttgtaaatgtaacgtatttagacgacagatcttcgttaaaaagttttccatctatgtagaatccatcGgttgttaacaccattcccgcgtcagat tgaataggagtttgaatagtttgtttggaaatagatccttcaataacttatagttgggtgggaaaaaatcgatttttatcactagactctttcttt tttactatcattacctcatgaactatttcttgaatgagtatatgtattttctttcctatatcggacgcgttcattggaaaatataccatgtcgttaa ctataagaatattttatcctcgtttacaaactgaataatatcagatgtagttcgtaaacgaactatatcatcaccagcacaacatctaactat atgatatccactagtttcctttagCcgtttattatcttgttccatattagcagtcattccatcatttaagaaggcgtcaaaAataatagggagaa atgacattttggattctgttacGactttaccaaaattaaggatatacggacttactatctttttctcaacgtcaatttgatgaacacacgatgaa

FIG. 12AC aatgtGcttcTatgagattgatcatgtagaaaacaacaagggatacaatatttccgcatatcatgaaatatattaagaaatcccaccttatt atatttccccaaaggatccatgcacgtaaacattatgccgttatcattaataaagacttctttctcatcggatctgtaaaagttgttactgatttt tttcattccaggatctagataattaataatgatgggttttctattcttattctttgtattttggcatatcctagaccagtaaacagtttccactttgg taaaatcagcagacttttgaacgctattaaacatggcattaatggcaataactaaaaatgtaaaatattttttctatgttaggaatatggttttt cactttaatagatatatggttttttggccaaaatgatagatattttttttatccgaggatagtaaaatattattagtcgccgtctctataaaaatga agctagtctcgatatccaattttattctagaattgataggagtcgccaaatgtaccttatacgttatatctcccttgatgcgttccatttgtgtatc tatatcggacacaagatctgtaaatagtttttacgttattaatcatcacggtatcgccgtcgctagataaCgctaatgtaccatccaagtccca aatggagagatttaactgttcatcgtttagaataaaatgattaccggtcatattaataaagtgttcatcgtatctagataacaacgacttataa ttaatgtccaagtcttgaactcgctgaatgatctttttttaacccagttagtttttagattggtacgaaatatattgttaaactttgattctaTagtaa tgtccaaatctagttgtggaaatacttccatcaacattgtttcaaacttgataatattattatctacatcttcGtacgatccaaattccggaata gatgtatcgcacgctctggccacccagataaccaaaaagtcacacgctccaggatatacattgtataaaaagctatcgttttttTagtagggt ttttttctgcgtgtatacgaagggattaaaaaatagtattatcaacgtaactatattccaaattattcttatgagaatagataataataatatcgtcctt aatatctaacaaatttcctaaatatccctttaattgagtcattcgaagcgtcaatagaatatgtctcttaactatttccggctgttgtatatttaa atgacttcgtaaaaaataatatatgggcgacttctcatctatgtaatcatatggagtgagatatagggctcgttctacctcctgcccccttaccc acctgtaataccaattgcggacttactatatatcgcatatttatatcgtggggtaaagtgaaaatctactaccgatgatgtaagtcttacaat gttcgaaccagtaccagatcttaatttggaggcctccgtagaactaggggaggtaaatatagatcaaacaacacctatgataaaggaGaa tagcggttttatatcccgCagtagacgtctattcgcccatagatctaaggatgatgagagaaaactagcactacgattctttttacaaagact ttattttttagatcatagagagattcattatttgttcagatgcgttgacgctgtaaaagacgtcactattaccaaaaaaaataacattatcgtgg cgccttatatagcacttttaactatcgcatcaaaaggatgcaaacttacagaaacaatgattgaagcattctttccagaactatataatgaac atagtaagaaatttaaattcaactctcaagtatccatcatccaagaaaaactcggataccagtttggaaactatcacgtttatgattttgaac cgtattactctacagtagctctggctattcgagatgaacattcatctggcatttttaatatccgtcaagagagttatctggtaagttcattatctg aaataacatatagattttatctaattaatctaaaatctgatcttgttcaatggagtgctagtacgggcgctgtaattaatcaaatggtaaatac tgtattgattacagtgtatgaaaagttacaactggtcatagaaaatgattcacaatttacatgttcattggctgtggaatcaAaacttccaata aaattacttaaagatagaaatgaattatttacaaaattcatTaacgagttaaaaaagaccagttcattcaagataagcaaacgcgataagg atacgctactaaaatattttacttaggactggagttagaatttatagacgactcatttcgtttatcattattactaccatcattattagtattcttct tgttatcttgttcagaaatatacagcaatgctatgcctaatactaaatacattatcatgcttgcaatggctctaacaacgacgaaccaaaatg aatttggtcgtagctttgttcacaaaaatacataaagaaatgtctacataaatctatggcgccattggctacttgaaatagcgccagtcctc ctacagattttaatatagctgtataacatgacatttattcatcatcaaaagagacagagtcaccatctgtcatatttagatttttttttcatgtgttc aaagtatcctctactcatttcattataatagtttatcatacttagaattttaggacggatcaatgagtaagacttgactagatcgtcagtagtaa tttgtgcatcgtctattctgcatccgcttcgtcgaataatgtatagcatcgctttgagattctccatagctatcaagtctttatacaatgacatgg aaatatctgtgaatactttatacttctccaacatcgatgccttaacatcatcgcctactttagcattgaaaatacgttctattgtgtagatggat gtaAcaagattttaaacaacaatgccatcttacacgatgattgcctcaagtctccaatcgtttgtttagaacgattagctacagagtccaat gcttggctgactagcatattattatctttagaaattgtattcttcaatgaGgcgtttatcatatctgtgatttcgttagtcatattacagtctgact gggttgtaatgttatccaacatatcacctatggatacggtacacgtaccagcatttgtaataatcctatctaagatgttgtatggcattgcgca gaaaatatcttctcctgtaatatctccactctcgataaatctactcagattattcttaaatgccttattctctggagaaaagatatcagtgtcca tcatttcattaatagtatacgcagaaaagataccacgagtatcaattctatccaagatacttatcggttccgagtcacagataatggtttcctc tccttcgggagatcctgcatagaaatatctaggacaatagtttctatactgtctgtaactctgataatctctaaagtcactaactgataccatg aaattgagaagatcaaacgctgaagtaatTaattttctgcctcgtttttactacaactagttttcatcaatgtagtgacgatgtattgtttagtt actTttggtctaatactgatgatagagatattattgcttcccataatggatcttcagtagtcaccttaaagcccattgatgcgaatagcagat agataaagtcttggtatgactcctttctaatatagtacggactacctttgtcacccaactttatacccacataagccataacaacctctttaat agccgtttcatgaggtttatcagccatgagcctgagtagttggaagaatctcatgaatccCgtctcagaaagtcctatatgcatgatagattt atctttcctgggaaactctcgtatagtcatagatgaaatactcttcaaagtttctgaaataagattagtaacagtcttacctccgactactctG ggtaacaaacaAactctaataggtgtttctctgcggagataatatcagaaaggatagagcaataagtagtattattgtgattataaagacc gaatacataacaggtagaatttataaacatcatgtcctgaaggttttagacttgtattcctcgtaatccataccgtcccaaaacatggatttg

FIG. 12AD gtaactttgatagccgtagatctttgttccttcgccaacaggttaaagaaattaataaagaatttgttgtttctatttatgtccacaaattgcacg tttggaagcgccacggttacattcactgcagcattttgaggatcgcgagtatgaagtacgatgttattgtttactggtatatctggaaagaaat ctaccagtctaggaataagagattgatatcgcatagaaatagtaaagtttataatctcatcatcgaagagcattttgttaccattgtaataaa tatccactctgtcatatgtataaatgaagtactgttcaaacatgatgagatgtttatatgttggcatagtagtgagatcgacgtttggtaatgg caatgtattaagattaactccataatgtctagcagcatctgcgatgttataagcgtcgtcaaagcggggtcgatcttgtattgttatatattgtc taacacctataagattatcaaaatcttgtctgcttaatacaccgttaacaatttttgccttgaattcttttattggtgcattaataacatccttata gaggatgttaaacaaataagtgttatcaaagttaagatctggatatttcttttctgctagaacatccattgagtcggagccatctggtttaata taaccaccgataaatctagctctgtattctgtatccgtcaatctaatattaagaaggtgttgagtgaaaggtggaagatcgtaaaagctgtg agtattaatgataggattagtttccgaactaatgttaattggggtattaataatatctatatttccagcgttaagtgtaacattaaacagttta attcacgtgaAgtAgtatcaattaaataattaatgcccaatttggatatagcagcctgaagctcatcttgtttagttacggatcctaatgagtt attaagcaatatatcgaacggatgaacgaaggttgttttGagttTgtcgcatactttgtaatctagacatagatgcggaagaacggtagaa actatacgaaataaatattcagagtcctctaattgatcaagagtaactattgacttaataggcatcatttatttagtattaaatgacgaccgta ccagtgacggatatacaaaacgatttaattacagagtttcagaagataattatccatctaacaaaaattatgaaataactcttcgtcaaatg tctattctaactcacgttaacaacgtggtagatagagaacataatgccgccgtagtgtcatctccagaggaaatatcctcacaacttaatga agatctatttccagatgatgattcaccggccactattatcgaacgagtacaacctcatactactattattgacgatactccacctcctacgtttc gtagagagttattaatatcggaacaacgtcaacaacgagaaaaaagatttaatattacagtatcgaaaaatgctgaagcaataatggaat ctagatctatgataacttctatgccaacacaaacaccatccttgggagtagtttatgataaagataaaagaattcagatgttagaggatgaa gtggttaatcttagaaatcaacgatctaatacaaaatcatctgataatttagataattttaccaaaatactatttggtaagactccgtataaat caacagaagttaataagcgtatagccatcgttaattatgcaaatttgaacgggtctcccttatcagtcgaggacttggatgtttgttcAgagg atgaaatagatagaatctataaaacgattaaacaatatcacgaaagtagaaaacgaaaaattatcgtcactaacgtgattattattgtcata aaTattatcgagcaagcattgctaaaactcggatttgaagaaatcaaaggactgagtaccgatatcacttcagaaattatcgatgtggaga tcggagatgactgcgatgctgtagcatcaaaactaggaatcggtaacagtccggttcttaatattgtattgtttatactcaagatattcgttaa acgaattaaaattatttaatttaatacattcccatatccagacaacaatcgtctggattaatctgttcctgtcgtctcataccggacgacatatt aatctttttattagtgggcatctttttagatggtttcttttcccagcattaactgagtcgatacctagaagatcgtgattgatctctccgaccatt ccacgaacttctaattggccgtctctgacggtaccataaactattttaccagcattagtaacagcttggacaatctgaccatccatcgcattgt acgatgtagtagtaactgttgttctacgtTtaggagcaccagaagtattttttggagccccttggaggCtgatgtagaagaagacgaggatttt gattttggtttacatgtaatacattttgaactctttgattttgtatcacatgcgccggcagtcacatctgtttgagaattaagattattgttgcctc ctttgacggctgcatctccaccgatttgcgctagtagattttttaagctgtggtgtaatcttattaactgtttcgatataatcatcgtaactgcttct aacggctaaatttttttatccgccatttagaagctaaaaatatttttatttatgcagaagatttaactagattatacaatgaactaatatgatc cttttccagattatttacaaacttggtattttttggttctggaggaggcgaatttaaattcggacttggattcagattttgtaagttcttgatcttat tatacatcgagtataggatggcgacagtaactgctacacaaataccgatcaaaagaagaataccaatcatttattgacaataacttcactat tgatcaagtatgcaatatatcatcttttcactaaataagtagtaataatgattcaacaatgtcgagatatatggacgataataatttagttcat ggaaatatcgctatgattggtgtgaatgactccgctaactctgtggggtgcgcagtgctttccccacatagaataaaattagcattccgactgt gataataataccaagtataaacgccataatactcaatactttccatgtacgagtgggactggtagacttactaaagtcaataaaggcgaag atacacgaaagaatcaaaagaatgattccagcgattagcacgccggaaaaataatttccaatcataagcatcatgtccatttaactaataa aaattttaaatcgccgaatgaacaaagtggaatataaaccatataaaaacaatagtttgtactgcaaaaataatatctattttttgttttcgaa gatatggtaaaattaaatagtagtacacagcatgttataactaacagcagcaacggctcgtaattacttatcatttactagacgaaaaggtg gtgggatattttcttgctcaaataatacgaatatatcacccatccattttatgcgatgtttatatactctaatctttaatagatctatagacgacg ggtttaccaacaatatagatttttatcgattcatctaatttaaacccttccttaaacgtgaatgatctattatctggcataacgatgacTctacct gatgaatcggacaatgtactgggccatgtagaataaaattatcaacgaattatcgtctacgaacatttatatcatttgtttttaattttaggacgc gaataaatggatataaaatagaaaataacagatattacaaccaGtgttatggccgcgcccaaccaggtaggcagttttatttatcttttact acaggttctcctggatgtacgtcaccaacggcggacgtagttctagtacaattagacgtaagttccgcttgggaatttttttaacgctaaagag ttaacgttaatcgtgcacccaacgtatttacatctagttctttgaacatcttgattataatataaccattttctatctctagattcgtcggtgcact catgtaaccaacataccctaggtcctaaatatttatctccggaattagattttggataattcgcgcaccaacaatttctatttcctttatgatcgt

FIG. 12AE tacaaaagacgtataatgccgtatccccaaaagtaaaataatcaggacgaataattctaataaactcagaacaatatctcgcatccatatg
tttggagcaaatatcggaataagtagacatagccggtttccgttttgcacgtaaccattctaaacaattggggtttccaggatcgtttctacaa
aatccagtcatgaaatcGtcacaatgttctgtcttgtaattattattaaatattttggacagtgtttggtatttgtcttagaacaacattttgcTa
cgctatcactatcgcccaggagataatccttttttataaaatgacatcgttgcccggatgctatataatcagtAgcgtgttttaaatccttaata
tattcaggagttacctcgttctgataatagattaatgatccaggacgaaatttgaaagaactacatggttctccatgaattaatacatattgttt
agcaaattcaggaactataaaactactacaatgatctatcgacataccatctatcaaacaaaacttgggtttaatttctcccggagatgtttc
ataatagtacgtataactttcttctgcaaacttaacagctctattatattcaggataattaaaacctaattccatatatttgtctcgtatatctgc
tattcctggtgctattttgattctattaagagtaacagctgcccccattcttaataatcgtcagtatttaaactgttaaatgttggtatatcaaca
tctaccttatttcccgcagtataaggtttgttgcaggtatactgttcaggaatggttacatttatacttcttctatagtcctgtctttcgatgttcat
cacatatgcaaagaacagaataaacaaaataatgtaagaaataatattaaatatctgtgaattcgtaaatacattgattgccataataatta
cagcagctacaatacacacaatagacattcccacagtgttgccattacctccacgatacatttgagttactaagcaataggtaataactaag
ctagtaagaggcaatagaaaagatgagataaatatcatcaatatagagattagaggagggctatatagagccaagacgaacaaaatca
aaccgagtaacgttctaacatcattattttgaagattcccaaataatcattcattcctccataatcgttttgcatcatacctccatctttaggca
taaacgattgctgctgttcctctgtaaataaatctttatcaagcactccagcacccgcagagaagtcgtcaagcatattgtaatatcttaaata
actcatttatatattaaaaaatgtcactattaaagatggagtataatctttatgccgaactaaaaaaaatgacttgtggtcaaccccctaagtc
ttttaacgaagacggggatttcgtagaagttgaaccgggatcatcctttaagtttctgatacctaagggattttacgcctctccttccgtaaa
gacgagtctagtattcgagacattaacaacgaccgataataaaatcactagtatcaatccaacaaatgcgccaaagttatatcctcttcaac
gcaaagtcgtatctgaagtagtttctaatatgaggaaaatgatcgaatcaaaacgtcctctatacattactcttcacttggcgtgtggatttgg
taagactattaccacgtgttatcttatggctacacacggtagaaaaaccgtcatttgcgtacccaataaaatgttaatacatcaatggaaga
cacaggtagaggcagtcggattggaacataagatatccatagatggagtaagtagtctattaaaggaactaaagactcaaagtccggatg
tattaatagtagtcagtagacatctgacaaacgatgcctttgtaaatatatcaataagcattatgatttgttcatcttggatgaatcacatacg
tataatctgatgaacaatacagcagttacaagattttttagcgtattatcctccgatgatgtgttattttttaactgctacacctagaccatctaa
cAgaatttattgtaacagtattattaatattgccaagttatccgatctaaaaaaaactatctatgcGgtagatagtttttttgagccatattcca
cagacaatattagacatatgataaaacgattagatggaccatctaataaatatcatatatatacTgagaagttattatctgtagacgagcct
agaaatcaacttattcttgataccctggtagaagaattcaagtcaggaactattaatcgcattttagttattactaaactacgtgaacatatgg
tattCttctacaaacgattattagatcttttcggaccagaggttgtatttataggagacgcccaaaatagacgtactccagatatggtcaaatc
aatcaaggaactaaatagatttatattcgtatccaccttattttattccggtactggtttagatattcctagtttggattcgttgttcatttgctcgg
cagtaatcaacaatatgcaaatagagcaattactagggagggtatgtcgagaaacagaactattagataggacggtatatgtatttcctaa
cacatccatcaaagaaataaagtacatgataggaaatttcatgcaacgaattattagtctgtctgtagataaactaggatttaaacaaaaa
agttatcggaaacatcaagaatccgatcccacttctgtatgtacaacatcctccagagaagaacgtgtattaaatagaatatttaactcgca
aaatcgttaagaagtttaagcgacgatccgcatgctgcgcaggccagtgtattacccctcatagtattaatataatccaatgatactttgtg
atgtcggaaatcttaaccaatttagactgacaggcagaacacgtcatgcaatcatcatcgtcatcgataactgtagtcttgggcttcttttgc
ggctcttcattccggaacgcacattggtgctatccatttaggtagtaaaaaataagtcagaatatgccctatagcacgatcgtgcaaaacct
ggtatatcgtctctatctttatcacaatatagtgtatcgacatCtttattattattgacctcgtttatcttggaacatggaatgggaacatttttgt
tatcaacggccatctttgccttaattccagatgttgtaaaattataactaaacagtctatcatcgacacaaatgaaattcttgtttagacgtttg
tagtttacgtatgcggctcgttcgcgtctcatttttcagatattgcaggtactataatattaaaaataagaatgaaataacataggattaaaa
ataaagttatcatgacttctagcgctgatttaactaacttaaaagaattacttagtctgtacaaaagtttgagattttcagattctgcggctata
gaaaagtataattctttggtagaatggggaacatctacttactggaaaataggcgtgcaaaaggtagctaatgtcgagacgtcaatatctg
attattatgatgaggtaaaaaataaaccgtttaatattgatccgggctattacattttcttaccggtatattttgggagcgtctttatttattcga
agggtaaaaatatggtagaacttggatctggaaactcttttcaaataccagatgatatgcgaagtgcgtgtaacaaagtattagacagcga
taacggaatagactttctgagatttgtttgttaaacaatagatggataatggaagatgctatatcaaaatatcagtctccagttaatatattt
aaactagctagtgagtacggattaaacatacccaaatatttagaaattgaaatagaggaagacacattatttgacgacgagttatactctat
tatagaacgctctttcgatgataaatttccaaaaatatccatatcgtatattaagttggggagaacttaggcggcaagttgtagactttttcaaa
ttctcGttcatgtatattgagtccatcaaggtagatcgtataggagataatattttttattcctagcgttataacaaaatcaggaaaaaagatat

FIG. 12AF tagtaaaagatgtagaccatttaatacgatccaaggttagagaacatacatttgtaaaagtaaaaaagaaaaacacattttccattttatac
gactatgatggaaacggaacagaaactagaggagaagtaataaaacgaattatagacactataggacgagactattatgttaacggaaa
gtatttctctaaggttggtagtgcaggcttaaagcaattgactaataaattagatattaatgagtgcgcaactgtcgatgagttagttgatgag
attaataaatccggaactgtaaaacgaaaaataaaaaaccaatcagcAtttgatttaagcagagaatgtttgggatatccagaagcggat
tttataacgttagttaataacatgcggttcaaaatagaaaattgtaaggttgtaaatttcaatattgaaaatactaattgtttaaataacccga
gtattgaaactatatatggaaactttaaccagttcgtctcaatctttaatAtcgtcaccgatgtcaaaaaaagattattcgagtgaaataatat
gcgcctttgatataggtgcaaaaaatcctgccagaactgttttagaagtcaaggataactccgttagggtattggatatatcaaaattagact
ggagttctgattgggaaaggcgcatagctaaagatttgtcacaatatgaatacactacagttcttctagaacgtcagcctagaaggtcgccg
tatgttaaatttatctattttattaaaggcttttatatcatacatcggctgccaaagttatttgcgtctcgcctgtcatgtctggtaattcatatag
agatcgaaaaaagagatcggtcgaagcatttcttgattggatggacacattcggattgcgagactccgttccggatagacgcaaattagac
gatgtagcggatagtttcaatttggctatgagatacgtattagataaatggaatactaattatacaccttataataggtgtaaatctagaaatt
acataaaaaaaatgtaataacgttagtaacgccattatggataatctatttacctttctacatgaaatagaagatagatatgccagaactatt
tttaactttcatctaataagttgcgatgaaataggagatatatatggtcttatgaaagaacgcatttcctcagaggatatgtttgataatatag
tgtataataaagatatacatcctgccattaagaaactagtgtattgcgacatccaacttactaaacacattattaatcagaatacgtatccgg
tatttaacgattcttcacaagtgaaatgttgtcattatttcgacataaactcagataatagcaatattagctctcgtacagtagagatatttgag
agggaaaagtcatctcttgtatcatatattaaaactaccaataagaagagaaaggtcaattacggcgaaataaagaaaactgttcatgga
ggcactaatgcaaattactttttccggtaaaaagtctgacgagtatctgagtactacagttagatccaacattaatcaaccttggatcaaaac
catCtctaagagGatgagagtTgatatcattaatcactctatagtaacgcgtggaaaaagctctatattacaaactatagaaattatttttac
taatagaacatgtgtgaaaatattcaaggattctactatgcacattattctatccaaggacaaggatgaaaaggggtgtatacacatgattg
acaaattattctatgtctattataatttatttctgttgttcgaGgatatcatccaaaacgagtactttaaagaagtagctaatgttgtaaaccac
gtactcacggctacggcattagatgagaaattattcctaattaagaaaatggctgaacacgatgtttatggagttagcaatttcaaaatagg
gatgtttaacctgacatttattaagtcgttggatcataccgttttcccctctctgttagatgaggatagcaaaataaagtttttttaaggggaaaa
agctcaatattgtagcattacgatctctggaggattgtataaattacgtgactaaatccgagaatatgatagaaatgatgaaggaaagatcg
actattttaaatagcatagatatagaaacggaatcggtagatcgtctaaaagaattgcttctaaaatgaaaaaaaacactGattcagaaat
ggatcaacgactCggAtataagttttttggtgcctgatcctaaagccggagtttttatagaccgttacatttccaatatgtatcgtattctaatt
ttatattgcatcgattgcatgaaatcttgaccgtcaagcggccactcttatcgtttaagaataatacagaacgaattatgatagaaattagca
atgttaaagtgactcctccagattactcacctataatcgcgagtattaaaggtaagagttatgacgcattagccacgttcactgtaaatatctt
taaagaggtaatgaccaaagagggtatatccatcactaaaataagtagttatgagggaaaagattctcatttgataaaaattccgctacta
ataggatacgggaataaaaatccacttgatacagccaagtatcttgttcctaatgtcataggtggagtctttatcaataaacaatctgtcgaa
aaagtaggaattaatctagtagaaaagattacaacatggccaaaatttagggttgttaagccaaactcattcactttctcgttttcctccgtat
cccctcctaatgtattaccgacaagatatcgccattacaagatatctctggatatatcacaattggaagcgttgaatatatcatcgacaaaga
catttataacggtcaatattgttttgctgtctcaatatttatctagagtgagtctagaattcattagacgtagtttatcatacgatatgcctccag
aagttgtctatctagtaaacgcgataatagatagtgctaaacgaattactgaatctattactgactttaatattgatacatacattaatgacct
ggtggaagctgaacacattaaacaaaaatctcagttaacgattaacgagttcaaatatgaaatgctgcataacttttttacctcatatgaact
atacacccgatcaactaaagggatttatatgatatctttactaagaaagtttctctactgtatcttccacacttctagatatccagatagagat
tcgatggtttgtcatcgcatcctaacgtacggcaaatattttgagacgttggcacatgatgaattagagaattacataggcaacatccgaaa
cgatatcatgaacaatcacaagaacagaggcacttacgcggtaaacattcatgtactaacaactcccggacttaatcacgcgttttctagct
tattgagtggaaagttcaaaaagtcagacggtagttatcgaacacatcctcactattcatggatgcagaatatttctattcctaggagtgttg
gattttatccggatcaagtaaagatttcaaagatgtttctgtcagaaaataccatccaagtcaatatctttactttttgttcatcagacgttccgg
aaagaggtcctcaggtaggtttagtatctcaattgtctgtcttgagttccattacaaatatactaacgtctgagtatttggatttggaaaagaa
aatttgtgagtatatcagatcatattataaagatgatataagttactttgaaacaggatttccaatcactatagaaaatgctctagtcgcatct
cttaatccaaatatgatatgtgattttgtaactgactttagacgtagaaaacggatgggattcttcggtaacttggaggtaggtattactttagt
tagggatcacatgaatgaaattcgcattaatattggagcgggaagattagtcagaccattcttggttgtggataacggagagctcatgatgg
atgtgtgtccggagttagaaagcagattagacgacatgacattctctgacattcagaaagagtttccgcatgtcatcgaaatggtagatata

FIG. 12AG gaacaatttacttttagtaacgtatgtgaatcggttcaaaaatttagaatGatgtcaaaggatgaaagaaagcaatacgatttatgtgacttt cctgccgaatttagagatggatatgtGgcatcttcaTtagtgggaatcaatcacaattctggacccagagctattcttggatgtgctcaagct aaacaagctatctcttgtctgagTtcggatatacgaaataaaatagacaatggaattcatttgatgtatccagagaggccaatcgtgattag taaggctttagaaacttcaaagattgcggctaattgcttcggccaacatgttactatagcattaatgtcgtacaaaggtatcaatcaagagg atggaattatcatcaaaaaacaatttattcagagaggcggtctcgatatAgttacCgcAaagaaacatcaagtagaaattccAttggaaa actttaataacaaagaaagagataggtctaacgcCtattcAaaattagaaagtaatggattagttagactgaatgctttcttggaatccgg agacgctatggcacgaaatatctcatcaagaactcttgaagatgattttgctagagataatcagattagcttcgatgtttccgagaaatatac cgatatgtacaaatctcgcgttgaacgagtacaagtagaacttactgacaaagttaaggtacgagtattaaccatgaaagaaagaagacc cattctaggagacaaatttaccactagaacgagtcaaaagggaacagtcgcgtatgtcgcggatgaaacggaacttccatacgacgaaa atggtatcacGccagatgtcattattaattctacatccatcttctctagaaaaactatatctatgttgatagaAgttattttaacagccgcatat tctgctaagccgtacaacaataagggagaaaaccgacctgtctgttttcctagtagtaacgaaacatccatcgatacatatatgcaattcgc taaacaatgttatgagcattcaaatccgaaattgtctgatgaagaattatcggataaaatcttttgtgaaaagattctctatgatcctgaaac ggataagccttatgcatccaaagtattttttggaccaatttattacttgcgtctgagAcatttaactcaggacaaggcaaccgttagatgtag aggtaaaaagacgaagctcattagacaggcgaatgagggacgaaaacgtggaggaggtatcaagttcggagaaatggagagagactgt ttaatagcgcatggCgcagccaatactattacagaagttttgaaagattcggaagaagattatcaagatgtgtatgtttgtgaaaattgtgg agacatagcagcacaaatcaagggtattaatacatgtcttagatgttcaaaacttaatctctctcctctcttaacaaaaattgataccacgca cgtatctaaagtatttcttactcaaatgaacgccagaggcgtaaaagtcaaattagatttcgaacgaagAcctccttcgttttataaaccatt agataaagttgatctcaagccgtcttttctggtgtaatattctagtttggtagtagatacatatcaatatcatcaaattcgagatCcgaattata aaatgggcgtggattgttaactatagaatcggacgtctgatattcgaaaatctgtggagtttcaggttttggtggaggtgtaactgctacttg ggatactgaagtctgatattcagaaagctgtggatgttctggttcggcatccaccgatggtgtcacatcactaatcggttcggtaacgtctgt ggatggaggtgctacttctacagaacctgtagcctcagttgtcaacggagatacatttttaatgcgagAaaatgtataatttggtaatggttt ctcatgtggatctgaagaagaggtaagatatctactagaaagataccgatcacgttctagttctcttttgtagaacttaacttttctttctcCg catctagttgatattccaacctcttcacgttactacgttcagattccaattcacgttcgcatgggttacctccgcagttttacgagcgatttcac gttcagccttcatgcgtctctccCtctctctatcgagtttatcagagcagtctttctgaaggcgatcgaactccataaatttctccaacgctttga ttgtttccatagatttccgaaCttcagcttCtaggacGgCgattctttttctttcgaattcacagctggatgtAcaaccgtttccattaccgcca tctctaagtttctttttctagatcggcaacatttcatccccatgccttttacattcctcgagtctactgtcgtcgaaatatcgttccagctccttttcg acatcaataactttagcacgttgtctctcaagctctcttttgtagttatctgattccctggcacgtttaagatcttcatgcaattgagtcagctctt aacTTCCtctcttgcttcttcgtcatagtacGCGcaatcactGtgAgatccattgttaccacgtctacactcggcgagctcgcgtttaagag attcaatttcccgtttgtattggtccatgtttccattgctaccaccattagatttacaggctgctagttgtcgttcgagatcagaaatacgggtttt cttggaattgatttcgtcgatgtacttggcatcgaaacacttattaagttctttttccaattctacgattttatttctttcgcgagtcaattccctcct gtagtaactatctgtttttgtcagattcacgctctctacgtagactttcttgcaagttactaatttgttccctagcacgtccgagtttagttttatatg ctgaatagagttctgattcatcctttgagcagatctctagcgatcgtttaagattcctgattctagtctttagcctatttacctcctcagaagatg ttccgttaccgttgcgtttacactcgttaagctgtctatcaagatccatgattctatctctaagacgttgcatctctctttccatatcagcattgctt tcattattacgtctgcagtcactcaactgtctttcaatatctgagattctatctctaagacgtcgcatctctctctgtttcAgcattggtttcattat tacgtctacagtcgttcaactgtctttcaagatctgatattctagattggagtctgctaatctctgtagcattttcacggcattcactcagttgtct ttcaagatctgaAatttttagattggagtctgctaatctctgtaagatttcctcctccgctctcgatgcagtTggtcaacttattctctagttctcta atacgcgaacgcagtgcatcaacttcttgcgtgtcttcctggttgcgtgtacattcatcgagtctagattcgagatctctaacgcgtcgtcgttc ttcctcaagttctctgcgtactacagaaagcgtgtccctatcttgttgatatttagcaatttctgattctagagtactgattttgcttacgtagtta ctaatagttgtcttggccttatcaagatcctccttgtatttgtcgcattccttgatatccctacgaagtctggacagttcccattcgacattacga cgtttatcgatttcagctcggagatcgtcatcgcgttgttttagccacatacgactgagttcaagttctcgttgacaagatccatctactttcca ttcctaatagtatccagttccttttctagttctgaacgcatttctcgttccctatcaagcgattctctcaattctcggatagtcttcttatcaatttct aataaatctgaaccatcatctgtcccattttgaatatccctgtgttctttgatctcttttgtaagtcggtcgattctttcggttttataaacagaatc cctttccaaagtcctaatcttactgagtttatcactaagttctgcattcaattcggtgagtttctcttggcttcttccaactctgtttttaaactctc cactatttccgcattcttcctcgcatttatctaaccattcaattagtttattaataactagttggtaatcagcgattcctatagccgttcttgtaatt

FIG. 12AH gtgggaacataattaggatcttctaatggattgtatggcttgatagcatcatctttatcattattagggggatggacaaccttaattggttggtc
ctcatctcctccagtagcgtgtggttcttcaataccagtgttagtaataggcttaggcaaatgcttgtcgtacgcgggcacttcctcatccatc
aagtatttataatcgggttctacTtcAgaatattcttttctaagagacgcgacttcgggagttagtagaagaactctgtttctgtatctatcaac
gctggaatcaatactcaagttaaggatagcgaatacctcatcgtcatcatccgtatcttctgaaacaccatcatatgacatttcatgaagtct
aacgtattgataaatagaatcagatttagtattaaacagatccttaacctttttagtaaacgcatatgtatattttagatctccagatttcataat
atgatcacatgccttaaatgtcagtgcttccatgatataatctggaacactaatgggtgacgaaaaagatacagcaccatatgctacgttga
taaataaatctgaaccactaagtagataatgattaatgttaaggaaAagAaaatattcagtGtatagGtatgTcttGgcGtcatatcttgt
actaaacacgctaaacagtttGttAatgtgatcaatttccaaTagaTtaattagagcagcgggaataccaacaaacatattaccacatccg
tattttctatgaatatcacatatcatgttaaaaaatcttAatagaagagcgaatatctcgtctgacttaatgagAcgtagttcagcagcaaca
taagtcataactgtaaatagaacatactttcctgtagtgttgattctagactccacatcaacaccattattaaaaatagttttatatacatcttt
aatctgctctccgttaatcgtcgaacgttctagtatacggaaacactttgatttcttatctgtagttaatgacttagtgatatcacgaagaatatt
acgaattacatttcttgttttcttgagagacctgattcagaactcaactcatcgttccatagttttCtacctcagtggcgaaatctttggagtg
cttggtacatttttcaataaggttcgtgacctccatttattataaaaaatttattcaaaacttaactacaatcgggtaattataaGatcgtaAa
tctcccatgtggCggaatactaccatctatcgcatgtggatggacagtaggtaatggccatgggaacagtaatgAttgcatatttatctttct
tgcTagtattactgcatattgtcccaatgtttcgatgtgatgttctaacctatcaactgccgctgtatcacaacaatagtgtccgatgaaattaa
gattatgatccaatgtgtttaatatatgattatcaagtcttatacgatccgcgtctttttttgacaggatcaggttcttctacaggaagaagtttcg
gcctcttatgatattcatgtctgggaaacggtggtctagggtgaggctccggtatcggagtgggttttggattataatcatcatcgtctatgaC
ATCATcatcatcttcgacttcgatatttattttgctatcttgatgatgtcctgtatcagttgcattttcagcactcgactgaatattagcgcattca
ttgtctattattaccatatttctaaacccaaaatgtatgtgttgaacatcagtactatcgttgatgagtcttatagcatgaattcgcttatcgttat
cgggtttatcttctgtcaccttagcaattcctttttttattaaactctacataatcatatccatttctattgtttgttctaatataaacgagtatagca
tcattgctaaattttttcaatagtatcgaaaacagaatatcctaaaccatataatatatattcagggacactcaaactaaatgtccaggattct
cctaaatacgtaaactttaatagtgcgaaatcattcaaaaatctaccacttatagatagatagtacataaatgcgtatagtagtctacctatc
tctttattatgaaaaccggcattacgatcatatatgtcgtgatatacctgtgatccgtttacgttaaaccataaatacatgggtgatcctataa
acatgaatttatttctaattctcagagctatagttaattgaccgtgtaatatttgcttacatgcatacttgatacgctcattaataaaattttttatc
attgctcgttatctcagaatcgtatatataaggagtaccatcgtgattcttaccagatattatacaaaatactatatataaaatatattgacca
acgttagtaatcatatataaatgtttaacgttttaaattttgtattcaatgatccattatcatacgctagcatggtcttatgatattcattctttaaaa
tataatattgtgttagccattgcattgggggctcctaatggagatttttttattctcatccattttaggataggctttcataaagtccctaataacttc
gtgaataatgtttctatgtttctactgatgcatgtatttgcttcgatttttttatcccatgtttcatctatcatagatttaaacgcagtaatgctcgc
aacattaacatcttgaaccgttggtacaattccgttccataaatttataatgttcgccatttatataactcatttttttgaatatacttttaattaac
aaaagagttaagttactcatatgggcgccgtccagtctgaacatcaatctttttagccagagatatcatagccgctcttagagtttcagcgtg
attttccaacctaaatagaacttcatcgttgcgtttacaacactttctatttgttcaaactttgttgttacattagtaatcttttttttccaaattagtt
agccgttgtttgagagtttcctcattgtcgtcttcatcggctttaacaattgcttcgcgtttagcctctggctttttagcagcctttgtagaaaaaa
attcagttgctggaattgcaagatcgtcatctccggggaaaagagttccgtccatttaaagtacagattttagaaactgacactctgcgttatt
tatatttggtacaacacatggattataaatatcgatgttaataacatcagaaaatgtaaagtctatacattgttgcatcgtgttaaattttctaa
tggatctagtattattgggtccaacttctgcctgaaatccaaatatggaagcggatacaaaaccgtttcctggataaaccacacatctccact
tttgctttacatcagaaattgtgtcgttgacatcttgaactctcctatctaatgccggtgttccacctatagattttgaatattcgaatgctgcatg
agtagcattaaattccttaatattgccataattttcatatattgagtaaccctggataaaaagtaaacacaccgcagccgtcgctaccacaat
aaaaaaaattgatagagagttcatttataatctattagaagctgacaaaattttttttacacgcatcagacaatgctttaataaatagttcaac
atctacttttgtcatatcgaaccgatggtatgattctaacctagaattacatccgaaaaagttgactatgttcatagtcattaagtcattaacaa
acaacattccagactctggattataagacgatactgtttcgtcacaattacctaccttaatcatgtgattatgaatattggctattagagcacct
tctaagaaatctataatatctttgaaacacgatttaaaatcaaaccacgaatatacttctacgaagaaagttagtttacccataggagaaat
aactataaatggagatctaaatacaaaatccggatctatgatagttttaacattattatattctctattaaatacctccacatctaaaaatgtt
aatttttgaaactatgtcttcgtttattaccgtacctgaactaaacgctataagctctattgtttgagaactctttaaacgatattcttgaaataca
tgtaacaaagtttcctttaactcggtcggtttatctaccatagttacagaatttgtatccttatctataatataataatcaaaatcgtataaagtt

FIG. 12AI atataattatcgcgttcagattgggatctttttcaaatagactaaaaaccccatttctctagtaagtatcttatgtatatgtttgtaaaatatcttc atggtgggaatatgctctaccgcagttagccattcctcattgacagcggtagatgtattagacaaaactattccaatgtttaacaagggccat tttacgagattattaaatccttgtttgataaatgtagccaatgagggttcgagttcaacgacgattgaattctcttcccgcggatgctgcatgat gaacgacgggatgttgttcgattgatttggaattctttttcgactttttgtttatattaaatattttaaaatttatagcggatagcaattcatgtacc acggataatgtagacgcgtattgcgcatcgatatctttattattagataaatttatcaataaatgtgagaagtttgcctcgttaaggtcttccat ttaaatattatataaacatttgtgtttgtatcttattcgtcttttatggaatagttttttactagtaaagctgcaattacacactttgtccgtaaaac ataaatataaacaccagctttttatcaatcgttccaaaaagtcgacggcggacatttttaacatggcatctattttaaatacacttaggtttttgg aaaaaacatcattttataattgtaacgattcaataactaaagaaaagattaagattaaacataagggaatgtcatttgtattttataagccaa agcattctaccgttgttaaatacttgtctggaggaggtatatatcatgatgatttggttgtattggggaaggtaacaattaatGatctaaagat gatgctattttacatggatttatcatatcatggagtgacaagtagtggagcaatttacaaattgggatcgtctatcgatagactttctctaaat aggactattgttacaaaagttaataattatgatgatacattttttgacgacgatgattgatcgctattgcacaattttgtttttttactttctaatat agcgtttagattcttttcatgtgcgaatattgatttactaaaatatcgatgtttaacttttgttctatgacgtccttatcagcggtatcggtacat atacgtaattcaccttcacaaaatacggagtcttcgataataatagccaatcgattattggatctagcGgtctgtatcatattcaacatgttta atatatcctttcgtttcccctttacaggcatcgatcgtagcatatttccgcgtctgagatggaaatgttaaaactacaaaaatgcgtaatgtta gcccgtcctaatattggtacgtgtctataagtttggcatagtagaataatagacgtgtttaaatgccttccaaagtttaagaattctattagagt attgcatttttgatagtttatcGcctacatcatcaaaaataagtaaaaagtgtgctgatttttttatgattttgtgcgacagcaatacatttttctat gttacttttagttcgtatcagattatattctagagattcctgactactaacgaaattaatatgatttggccaaatgtatccatcataatctggAtt ataaacgggtgtaaacaagaatatatgtttatatttttttaactagtgtagaaaacagagatagtaaatagatagtttttccagatccagatcc tcccgttaaaaccattctaaacggcatttttaataaattttctcttgaaaattgttttcttggaaacaattcataattatatttacagttactaaa ttaatttgataataaatcaaaatatggaaaactaaggtcgttagtagggaggagaacaaagaaggcacatcgtgacataaataacatttat tatcatgatgacaccagaaaacgacgaagagcagacatctgtgttctccgctactgtttacAgagacaaaattcaGggaaagaataaac gcaaacgcgtgattggtctatgtattagaatatctatggttatttcactactatctatgattaccatgtccgcgtttctcatagtgcgcctaaatc aatgcatgtctgctaacgaggctgctattactgacgccgctgttgccgttgctgctgcatcatctactcatagaaaggttgcgtctagcactac Gcaatatgatcacaaagaaagctgtaatggtttatattaccagggttcttgttatatattacattcagactaccagttattctcggatgctaaa gcaaattgcactgcggaatcatcaacactacccaataaatccgatgtcttgaCtacctggctcattgattatgttAaggatacatgggggatc tgatggtaatccaattacaaaaactacatccgattatcaagattctgatgtatcacaagaagttagaaagtattttttgtgttaaaacaatgaa ctaatatttattttttgtacattaataaatgaaatcgcttaatagacaaactgtaagtaggtttaagaagttgtcggtgccggccgctataatga tgatactctcaaccattattagtggcataggaacatttctgcattacaaagaagaactgatgcctagtgcttgcgccaatggatggatacaat acgataaacattgttatttagatactaacattaaaatgtctacagataatgcggtttatcagtgtcgtaaattacgagccagattgcctagac cggatactagacatctgagagtattgtttagtattttttataaagattattgggtaagtttaaaaaagaccaatgataaatggttagatattaa taatgataaagatatagatattagtaaattaacaaattttaaacaactaaacagtacgacggatgctgaagcgtgttatatatacaagtctg gaaaactggttaaaacagtatgtaaaagtactcaatctgtactatgtgttaaaaaattctacaagtgacaacaaaaaatgaattaataata agtcgttaacgtacgccgccatggacgccgcgtttgttattactccaatgggtgtgttgactataacagatacattgtatgatgatctcgatat ctcaatcatggactttataggaccatacattataggtaacataaaaactgtccaaatagatgtacgggatataaaatattccgacatgcaaa aatgctactttagctataagggtaaaatagttcctcaggattctaatgatttggctagattcaacatttatagcatttgtgccgcatacagatc aaaaaataccatcatcatagcatgcgactatgatatcatgttagatatagaagataaacatcagccattttatctattcccatctattgatgttt ttaacgctacaatcatagaagcgtataacctgtatacagctggagattatcatctaatcatcaatccttcagataatctgaaaatgaaattgt Cgtttaattcttcattctgcatatcagacggcaatggatggatcataattgatgggaaatgcaatagtaatttttttatcataaaagttgtaaag taaataataaaacaataaatattgaactagtagtacgtatattgagcaatcagaaatgatgctggtacctcttatcacggtgaccgtagttg cgggaacaatattagtatgttatatattatatatttgtaggaaaaagatacgtactgtctataatgacaataaaattatcatgacaaaattaa aaaagataaagagttctaattccagcaaatctagtaaatcaactgatagcgaatcagactgggaggatcactgtagtgctatggaacaaa acaatgacgtagataatatttctaggaatgagatattggacgatgatagcttcgctggtagtttaatatgggataacgaatccaatgtTatg gcgcctagcacagaacacatttacgatagtgttgctggaagcacgctgctaataaataatgatcgtaatgaacagactatttatcagaaca ctacagtagtacttaatgaagataccaaacagaatcctaactattcatccaatcctttcgtaaattataataaaaccagtatttgtagcaagt

FIG. 12AJ caaatccgttcattacagaactcaacaataaatttagtgagaataatccgtttagacgagcacatagcgatgattatcttaataagcaagaa
caagatcatgaacacgatgatatagaatcattggtgtgattagtttccttttttataaaattgaagtaatatttagtattattgctgccgtcacgtt
gtacaaatggagatattccctgtattcggcatttctaaaattagcaattttattgctaataatgactgtagatattatatagatacagaacatc
aaaaaattatatctgatgagatcaatagacagatggatgaaacggtacttcttaccaacatcttaagcgtagaagttgtaaatgacaatga
gatgtaccatcttattcctcatagattatcgacgattatactctgtattagttctgtcggaggatgtgttatctctatagataatgacgtcaatgg
caaaaatattctaacctttcccattgatcatgctgtaatcatatccccactgagtaaatgtgtcgtagttagcaagggtcctacaaccatattg
gttgttaaagcggatataccctagcaaacgattggtaacatcgtttacaaacgacatactgtatgtaaacaatctatcactgattaattattTgc
cgttgtctgtattcattattagacgagttaccgactatttggatagacacatatgcgatcagatatttgcgaataataagtggtattccattata
accatcgacaataagcagtttcctattccatcaaactgtataggtatgtcctctgccaagtacataaattctagcatcgagcaagatacttta
atacatgtttgtaacctcgagcatccattcgacttagtatacaaaaaaatgcagtcgtacaattctgtacctatcaaggaacaaatattgtac
ggtagaattgataatataaatatgagcattagtatttctgtggattaatagatttctagtatggggatcattaatcatctctaatctctaaatac
ctcataaaacgaaaaaaaagctattatcaaatactgtacggaatggattcattctcttctcttttatgaaactctgttgtatatctactgataa
aactggaagcaaaaaatctgataaaaagaataagaataagatcaaggattattataaaataacaatagttcctggttcctcttccacgtct
actagctcgtggtattatacacatgcctagtaatagtctctttgcgttgacggaaagcagactagaaataacaggctaaaatgttcagacac
cataatagttcccaacccagataataacagagtaccatcaacacattcctttaaactcaatcccaaacccaaaaccgttaaaatgtatccg
gccaattgatagtagataatgaggtgtacagcgcatgatAatttacacagtaaccaaaatgaaaatactttagtaattataagaaatatag
atggtaacgtcatcatcaacaatccaataatatgccggagagtaaacattgacggataaaacaaaaatgctccgcataactctatcatggc
aataacacaaccaaatacttgtaagattcctaaattagtagaaaatacaacggatatcgatgtataagtgatctcgagaaataataagaat
aaagtaatgcccgtaaagataaacatcaacattgtttggtaatcattaaaccaattagtatgaagttgaactaatttcacagtagattttattc
cagtattatccccgcatgtataagtacctggtaagatatctttatattccataatcaatgagacatcactatctgataacgaatgaagtctagc
actagtatgccatttacttaatattgtcgtcttggaagtttttattataagttaaaatatcatggttatccaatttccatctaatatactttgtcggat
tatctatagtacacggaataatgatggtatcattacatgctgtatactctatggtctttgtagttgttataacaaccaacgtatagaggtatatc
aacgatattctaactcttgacatttttatttatttaaaatgatacctttgttatttattttattctattttgctaacggtattgaatggcataagtttg
aaacgagtgaagaaataatttctacttacttattagacgacgtattatacacgggtgttaatggggcggtatacacattttcaaataataaac
taaacaaaactggtttaactaataataattatataacaacatctataaaagtagaggatgcggaaccaataacggaaatcccaaatgttg
gaaaatagacggttcagacgacccaaaacatagaggtagaggatacgctccttatcaaaatagcaaagtaacgataatcagtcacaacg
gatgtgtactatctgacataaacatatcaaaagaaggaattaaacgatggagaagatttgacggaccatgtggttatgatttatacacggc
ggataacgtaattccaaaagatggtttacgaggagcattcgtcgataaagatggtacttatgacaaagtttacattctttttcactgatactatc
ggctcaaagagaattgtcaaaattccgtatatagcacaaatgtgcctaaacgacgaaggtggtccatcatcattgtctagtcatagatggtc
gacgtttctcaaagtcgaattagaatgtgatatcgacggaagaagttatagacaaattattcattctagaactataaaaacagataatgata
cgatactatatgtattcttcgatagtccttattccaagtccgcattatgtacctattctatgaataccattaaacaatcttttctacgtcaaatt
ggaaggatatacaaagcaattgccgtctccagctcctggtatatgtttaccagctggaaaagttgttccacataccacgtttgaagtcataga
aaaatataatgtactagatgatattataaagcctttatctaaccaacctatcttcgaaggaccgtctggtgttaaatggttcgatataaagga
gaaggaaaatgaacatcgggaatatagaatatacttcataaaagaaaattctatatattcgttcgatacaaaatctaaacaaactcgtagc
tcgcaagtcgatgcgcgactattttcagtaatggtaacttcgaaaccgttatttatagcagatatagggataggagtaggaatgccacaaat
gaaaaaaaatacttaaaatgtaatcttaatcgagtacaccgcacgacaatgaacaaacataagacagattatgctggttatgcttgctgcgt
aatatgcggtcaattgttggaattatttttacagcgacactattaaaagttgtagaacgtaaattagttcatacaccatcaatagataaaac
gataaaagatgcatatattagagaagattgtcctactgactggataagctataataataaatgtatccatttatctactgatcgAaaaaacc
tgggaggaaggacgtaatgcatgcaaagctctaaatccaaattcggatctaattaagatagagactccaaacgagttaagttttttaagaa
gcCttagacgAggCtattgggtaggagaatccgaaatattaaaccagacaaccccatataattttatagctaaaaatgccacgaagaatg
gaactaaaaaacggaaatatatttgtagtacaacgaatactcccaaactgcattcgtgttacactatataacaattacactacatttttatca
taacactacttcggttagatgtttagaaaaaaataaatatcgccgtaccgttcttgttttttataaaaataacaattaacaattatcaaatttttt
ctttaatattttacgtggttgaccattcttggtggtaaaataatctcttagtgttggaatggaatgctgtttaatgtttccgcactcatcgtatatt
ttgacgtatgcagtcacatcgtttacgcaatagtcagactgtagttctatcatgcttcctacatcagaaggaggaacagttttaaagtctcttg

FIG. 12AK gttttaatctattgccattagttttcatgaaatcctttgttttatccacttcacattttaaataaatgtccactatacattcttctgttaattttactag
atcgtcatgggtcatagaatttataggttccgtagtccatggatccaaactagcaaacttcgcgtatacggtatcgcgattagtgtatacacc
aactgtatgaaaattaagaaaacagtttaataaatcaacagaaatatttaatcctccgtttgatacagatgcgccatatttatggatttcgga
ttcacacgttgtttgtctgaggtgttcgtctagtgttgcttctacgtaaacttcgattcccatatattctttattgtcagaatcgcataccgatttat
catcatacactgtttgaaaactaaatggtatacacatcaaaataataaataataacgagtacattctgcaatattgttatcgtaattggaaaa
ttagtgttcgagtgagtcggattatgtgagtactggattgtatattttatttttatattttgtaataagaataaaatgctaatgtcaagtttattcca
atagatgtcttattaaaaaacatatataataaataacaatggctgaatggcataaaattatcgaggatatctcaaaaaataataagttcga
ggatgccgccatcgttgattacaagactacaaagaatgttctagctgctattcctaacagaacatttgccaagattaatccgggtgaaattat
tcctctcatcactaatcgtaatattctaaaacctcttattggtcagaaatattgtattgtatatactaactctctaatggatgagaacacgtatg
ctatggagttgcttactgggtacgcccctgtatctccgatcgttatagcgagaactcataccgcacttatatttttgatgggtaagccaacaac
atccagacgtgatgtgtatagaacgtgtagagatcacgctacccgtgtacgcgcaactggtaattaaaataaaaagtaatattcatatgtag
tgtcaattttaaatgatgatgatgaaatggataatatccatattgacgatgtcaataatgccggtattggcatacagctcatcgattttttagatt
tcattcagaggatgtggaattatgttatgggcatttgtattttgataggatctataatgtagtaaatataaaatataatccgcatattccatata
gatataattttattaatcgcacgttaaccgtagatgaactagacgataatgtcttttttacacatggttattttttaaaacacaaatatggttcac
ttaatcctagtttgattgtctcattatcaggaaacttaaaatataatgatatacaatgctcagtaaatgtatcgtgtctcattaaaaatttggca
acgagtacatctactatattaacatctaaacataagacttattctctacatcggtccacgtgtattactataataggatacgattctattatatg
gtataaagatataaatgacaagtataatgacatctatgatttactgcaatatgtatgctaatagcgtctacattgatagtgaccatatacgtg
tttaaaaaaataaaaatgaactcttaattatgctatgctattagaaatggataaaatcaaaattacggttgattcaaaaattggtaatgttgtt
accatatcgtataacttggaaaagataactattgatgttacacctaaaaagaaaaaagaaaaggatgtattattagcgcaatcagttgctgt
cgaagaggcaaaagatgtcaaggtagaagaaaaaaatattatcgatattgaagatgacgatgatatggatgtagaaagcgcataatacg
atctataaaaataagtatataataaatactttttatttacggtactcttgtagtggtgatacccctactcaattatttttttaaaaaaatacttattc
tgattcttctagccatttccgtgttcgttcgaatgccacatcgacgttaaagataggggagtagttgaaatctagttctgcattgttggtacgca
cctcaaatgtagtgttggatatcttcaacgtatagttgttgagtagtgatggttttctaaatagaattctcttcatatcattcttgcacgcgtacat
ttttagcatccatcttggaattctagatccttgttctattcccaatggtttcatcaatagaagattaaacatatcgtacgaacacgatggagagt
aatcgtagcaaaagtaagcatttcctttaatcttagatcccggatactggatatatttgcagccaacacgtgcatccatgcagcatttcctac
atatacccggctatgcaccgcgtcatcatcgactgtacgatacataatgttaccgtgttgcttacattgctcgtaaaagactttcgtcaatttgt
ctccttctccgtaaattccagtgggtcttaggcaacaagtatacaattttgctccattcatgattacggaattattggctttcataaccagttgct
cggccatacgtttactttttgcgtatacatgtcctggtgatatatcataaagggtatgctcatggccgatgaatggatcaccgtgtttattgggt
cctattgcttccatgctactagtatagatcaaatacttgattcctaggtccacacaagctgccaatatagtctgtgttccataatagtttactttc
atgatttcattatcggtgtattttccaaatacatccactagagcagccgtatgaataatcagatttaccccatctagcgcttctctcaccttatc
aaagtcgtttatatcacattgtatatagtttataaccttaactttcgaggttattggttgtggatcttctacaatatctatgactctgatttcttgaa
catcatctgcactaattaacagttttactatatacctgcctagaaatccggcaccaccagtaaccgcgtacacggccattgctgccactcata
atatcagactacttattctattttactaaataatggctgtttgtataatagaccacgataatatcagaggagttatttactttgaaccagtccat
ggaaaagataaagtttaggatcagttattggattaaaatccggaacgtatagtttgataattcatcgttacggagatattagtcaaggatgt
gattccataggcagtccagaaatatttatcggtaacatctttgtaaacagatatggtgtagcatatgtttatttagatacagatgtaaatatatt
tacaattattggaaaggcgttatctatttcaaaaaatgatcagagattagcgtgtgtggagttattggtatttcttacataaatgaaaagataata
cattttcttacaattaacgagaatggcgtttgatatatcagttaatgcgtctaaaacaataaatgcattagtttactttttctactcagcaaaata
aattagtcatacgtaatgaagttaatgatacacactacactgtcgaatttgatagggacaaagtagttgacacgtttatttcatataatagac
ataatgacaccatagagataagaggggtgcttccagaggaaactaatattggttgcgcggttaatacgccggttagtatgacttacttgtat
aataagtatagtttttaaactgattttagcagaatatataagacacagaaatactatatccggcaatatttattcggcattgatgacactagat
gatttggctattaaacagtatggagacattgatctattatttaatgagaaacttaaagtagactccgattcgggactatttgactttgtcaactt
tgtaaaggatatgatatgttgtgattctagaatagtagtagctctatctcagtctagtatctaaacattgggaattgacaaataaaaagtatag
gtgtatggcattagccgaacatatatctgatagtattccaatatctgagctatctagactacgatacaatctatgtaagtatctacgcggaca
cactgagagcatagagaggatgaatttgattattttgaagacgatgattcgtctacatgttctgccgtaaccgacagggaaacggatgtataatt

FIG. 12AL tttttatagcgtgaaggatatgataaaaaatataattgttgtatttatcccattccaatcaccttatatgattctgtaaaaaaattatactgtaa
cacaataaaggagtcttatagatgtatagaggtcagatactggtttgataaactgtttattccacataagtatgtttgactttatggttagacc
cgcatactttaacaaatcactgaaaattggagttaggtattgacctctcagaatcagttgccgttctggaacattaaatgtatttttatgatat
actccaacgcatttatgtgggcatacaacaagtcattactaatggagtattccaagagtttttagttgtctagtatttaacaagagaagagattt
caacagactgtttatgaactcgaacgccgcctcattgtcgcttatattgatgatgtcgaattctcccaatatcatcactgatgagtagctcatct
tgttatcgggatccaagttttctaaagatgtcattaaaccctcgatcatgaatggatttatcatcatcgtttttatgttggacatgagcttagtcc
gtttgtccacatctatagacgacgatttctgaattatttcatatatccctctctttaactccaggaacttgtcaggatggtctactttaatatgttc
tcgtctaagagatgaaaatctttggatggttgcacgcgacttttctttaaaggatgacgttgcccaagatcctctcttaaatgaatccatcttat
ccttggacaagatggacagtctattttccttagatggtttaatatttttgttacccatgatctataaaggtagacctaatcgtctcggatgacca
tatatttattttcagttttattatacgcataaattgtaaaaaatatgttaggtttacaaaaatgtctcgtggggcattaatcgttttgaaggattg
gacaaatctggaaaaacaacacaatgtatgaacatcatggaatctataccggcaaacacgataaaatatcttaactttcctcagagatcca
ctgtcactggaaagatgatagatgactatctaactcgtaaaaaaacctataatgatcatatagttaatctattattttgtgcaaatagatggg
agtttgcatctttatacaagaacaactagaacagggaattactttaatagttgatagatacgcattttctggagtagcgtatgccgccgctaa
aggcgcgtcaatgactctcagtaagagttatgaatctggattgcctaaacccgacttagttatattcttggaatctggtagcaaagaaattaa
tagaaacgtcggcgaggaaatttatgaagatgttacattccaacaaaaggtattacaagaatataaaaaaatgattgaagaaggagatat
tcattggcaaattatttcttctgaattcgaggaagatgtaaagaaggagttgattaagaatatagttatagaggctatacacacggttactgg
accagtggggcaactgtggatgtaatagtgaaattacatttttttataaatagatgttagtacagtgttataaatggatgaagcatattactctg
gcaacttggaatcagtactcggatacgtgtccgatatgcataccgaactcgcatcaatatctcaattagttattgccaagatagaaactatag
ataatgatatattaaacaaggacattgtaaattttatcatgtgtagatcaaacttggataatccatttatctctttcctagatactgtatatacta
ttatagatcaagagatctatcagaccgaattgattaattcattagacgacaatgaaattatcgattgtatagttaacaagtttatgagcttttat
aaggataacctagaaaatatagtagatgctatcattactctaaaatatataatgaataatccagattttaaaactacgtatgccgaagtact
cggttccagaatagccgatatagatattaaacaagtgatacgtaagaatatactacaattgtctaatgatatccgcgaacgatatttgtgaa
aaatattaaaaaaaaatactttttttattaaatgacgtcgcttcgcgaatttagaaaattatgctgtgatatatatcacgcatcaggatataaa
gaaaaatctaaattaattagagactttataacagatagggatgataaatatttgatcattaagctattgcttcccggattagacgatagaattt
ataacatgaacgataaacaaattataaaattatatagtataatatttaaacaatctcaggaagatatgctacaagatttaggatacggatat
ataggagacactattaggactttcttcaaagagaacacagaaatccgtccacgagataaaagcattttaactttagaagaagtggatagttt
tttaactacgttatcatccgtaactaaagaatcgcatcaaataaaattattgactgatgtagcatctgtttgtacatgtaatgatttaaaatgtg
tagtcatgcttattgataaagatctaaaaattaaagcgggccctcggtacgtacttaacgctattagtcctcatgcctatgatgtgtttagaaa
atctaataacttgaaagagataatagaaaatgcatctaaacaaaatctagactctatatctatttctgttatgactccaattaatcccatgtta
gcggaatcgtgtgattctgtcaataaggcgtttaaaaaatttccatcaggaatgtttgcggaagtcaaatacgatggtgaaagagtacaagt
tcataaaaataataacgagtttgccttctttagtagaaacatgaaaccagtactctctcataaagtggattatctcaaagaatacataccga
aagcatttaaaaaagctacgtctatcgtattggattctgaaattgttcttgtagacgaacataatgtaccgctaccgtttggaagtttaggaat
acacaaaaagaaagaatataaaaactctaacatgtgtttgttcgtgtttgactgtttgtactttgatggattcgatatgacggacattccattg
tacgaacgaagatcttttctcaaagatgttatggttgaaatacccaatagaatagtattctcagagttgacgaatattagtaacgagtctcag
ttaactgacgtattggatgatgcactaacgagaaaattagaaggattggtcttaaaagatattaatggagtatacgaaccgggaaagaga
agatggttaaaaataaagcgagactatttgaacgagggttccatggcagattctgccgatttagtagtactaggtgcctactatggtaaagg
agcaaagggtggtatcatggcagtctttctaatgggttgttacgacgatgaatccggtaaatggaagacggttaccaagtgttcaggacac
gatgataatacgttaagggagttgcaagaccaattaaagatgattaaaattaacaaggatcccaaaaaaattccagagtggttagtagtta
ataaaatctatattcccgattttgtagtagaggatccgaaacaatctcagatatgggaaatttcaggagcagagtttacatcttccaagtccc
ataccgcaaatggaatatccattagatttcctagatttactaggataagagaggataaaacgtggaagaatctactcatctaaacgattta
gtaaacttgactaaatcttaatagttacatacaaactgaaaattaaaataacaccatttagttggtggtcgccatggatggtgttattgtatac
tgtctaaacgcgttagtaaaacatggcgaggaaataaatcatataaaaaatgatttcatgattaaaccatgttgtgaaagagtttgtgaaaa
agtcaagaacgttcacattggcggacaatctcaaaaacaatacagtgattgcagatttgccatatatggataatgcggtatccgatgtatgca
attcactgtataaaaagaatgtatcaagaatatccagatttgctaatttgataaagatagatgacgatgacaagactcctactggtgtatata

FIG. 12AM attattttaaacctaaagatgttattcctgttatcatatctataggaaaggataaagatgtctgtgaactattaatctcatcagacatatcgtgt gcatgcgtggagttaaattcatatcacgtagccattcttcccatgaatgtttcctttttttaccaaaggaaatgcctcgttgattattctcctgtttg atttctctatcgatgcagcacctctcttaagaagtgtaaccgataataatgttattatatctagacaccagcgtctacatgacgagcttccgag ttccaattggttcaagttttacataagtataaagtccgactattgttctatattatatatggttgttgatggatctgtgatgcatgcgatagctga taatagaactcacgcaattattagcaaaaatatattagacaatactacaattaacgatgagtgtagatgctgttattttgaaccacagattag gattcttgatagagatgagatgctcaatggatcatcgtgtgatatgaacagacattgtattatgatgaatttacctgatgtaggcgaatttgga tctagtatgttggggaaatatgaacctgacatgattaagattgctctttcggtggctggtaatttaataagaaatcgagactacattcccggg agacgaggctatagctactacgtttacggtatagcctctagataatttttttaagcacgaaataaaaaacataattttaaaccaatctatttca tactattttgtgtgatcaccatggacataaagatagatattagtatttctggtgataaatttacggtgactactaggagggaaaatgaagaaa gaaaaaaatatctacctctccaaaaagaaaaaactactgatgttatcaaacctgattatcttgagtacgatgacttgttagatagagatgag atgtttactattctagaggaatatttttatgtacagaggtctattaggcctcagaataaaatatggacgactctcttaacgaaattaaaaaattcg acaatgatgcggaagaacaattcggtactatagaagaactcaagcagaaacttagattaaattctgaagagggagcagataactttatag attatataaaggtacaaaaacaggatatcgtcaaacttactgtatacgattgcatatctatgataggattgtgtgcatgcgtggtagatgttt ggagaaatgagaaactgttttctagatggaaatattgtttacgagcgattaaactgtttattaatgatcacatgcttgataagataaaatctat actgcagaatagactagtatatgtggaaatgtcatagaaagttaatgagagcaaaaatatataaggttgtattccatatttgttatttttttctgt aatagttaaaaaaatacattcgatggtctatctatcagattattatgtgttataaggtacttttttctcataataaactagagtatgagtaagata gtgtttttcaaaacatataaatctaaaattgatggatgagatatacagctattaatttcgaaaatatataaatctaaaattgatggataagat atacagctattaatttcgaaaatatattttaatctgataactttaaacatggattttttgatggtggtttaacgttttAaaaaaagattttgttattg tagtatatgataatattaaaagatggatataaagaatttgctgactgcatgtactattttttacattactacattggctacggcagatatacct actccgccaccaacgggtcatgtgacaagggagaatatcttgataagaggcataatcaatgttgtaatcggtgtccacctggagaatttgc caaggttagatgtaatggtaacgataacacaaaatgtgaacgctgcccacctcatacatataccacaatccccaattattctaatggatgtc atcaatgtagaaaatgcccaaccggatcatttgataaggtaaagtgtaccggaacacagaacagtaaatgttcgtgtcttcctggttggtat tgcgctactgattcttcacagactgaagattgttgaaattgtgtaccaaaaaggagatgtccatgcggatactttggtggaatagatgaaca aggaaatcctatttgtaaatcgtgctgtattggtgaatattgcaactacctacgtaattatagacttgatccattttctccatgcaaactatcta aatgtaattaattatgattttgatgataatgttaccatacattatatcgctacttggttagtgtattattcagtatgaagacctattaataattact tatcttttgacgatcttgttataattataatataaaaacttatggcatagtaactcataattgctgacgcgataaattcgtaataatctgttttgtt caaatttttataaggaatctacaggcataaaaataaaaatataatttataatatactcttacagcgcgccatcatgaatagcagcagtaaat taattgctgttattaatggatttagaaatagtggacgattttgtgatattaatatagttattaatgatgaaaggataaacgctcacagactcat cctatctggagcctccgaatattttttccattctgtttttccaataatttttatcgattctaatgaatacgaagttaatctaagtcatttagattatcaa agtgttaacgatttgatcgattacatttatgggataccctttgagcctaactaacgataacgtgaaatatattctttcaaccgctgattttttaca aattggatctgccattactgagtgcgaaaaatacatacttaaaaatctttgttctagaaactgtatcgatttctacatatacgctgataaatat aataacaagaaaatagaatcagcgtcgtttaacacaatattacgaaatattttgagactcatcaacgatgaaaactttaaatacttaacaga ggaatcaatgataaaaattttaagcgatgatatgttaaatataaaaaatgaggattttgtcaccactaattctcattaaatggttagagagtac tcaacaatcatgcaccgtcgagttacttagatgcctcagaatatcattgctttccccacaagttataaaatcactttatagtcatcaactggtta gttcaatctacgaatgtataacattcttaaacaatatagcattcttggatgaatcatttcctagataccatagcatcgagttgatatctatcggt ataagtaattcgcatgataagatttccataaactgctacaatcataaaaaaaatacatgggaaatgatatcttcacgtagatataggtgtag tttcgcagtggccgtcctggataatattatctatatgatgggtggatatgatcagtccccgtatagaagttcaaaggttatagcgtacaatac atgtacaaattcttggatatatgatataccagagctaaaatatcctcgttctaattgtggggggactggctgatgacgaatacatttattgtata ggcggcatacgcgatcaggattcatcgttgacatctagtattgatagatggaagccatcaaaaccatattggcagaagtatgctaaaatgc gcgaaccaaaatgtgatatggggggttgcgatgttaaacggattaatatatgtcatgggtggaatcgttaaaggtgacacgtgtaccgacgc actagagagtttatcagaagatggatggatgaagcatcaacgtcttccaataaaaatgtccaatatgtcgacgattgttcatgatggcaaga tttatatatctggaggttacaacaatagtagtgtagttaatgtaatatcgaatctagtccttagctataatccgatatatgatgaatggaccaa attatcatcattaaacattcctagaattaatcccgctctatggtcagcgcataataaattatatgtaggaggaggaatatctgatgatgttcga actaatacatctgaaacatacgataaagaaaaagattgttggacattggataatggtcacgtgttaccacgcaattatataatgtataaatg

FIG. 12AN cgaaccgattaaacataaatatccattggaaaaaacacagtacacgaatgattttctaaagtatttggaaagttttataggtagttgataga
acaaaatacataattttgtaaaaataaatcacttttatactaatatgacacgattaccaatacttttgttactaatatcattagtatacgctac
acctttcctcagacatctaaaaaaataggtgatgatgcaactctatcatgtaatcgaaataatacaaatgactacgttgttatgagtgcttg
gtataaggagcccaattccattattcttttagctgctaaaagcgacgtcttgtattttgataattataccaaggataaaatatcttacgactctc
catacgatgatctagttacaactatcacaattaaatcattgactgctagagatgccggtacttatgtatgtgcattctttatgacatcaactac
aaatgacactgataaagtagattatgaagaatactccacagagttgattgtaaatacagatagtgaatcgactatagacataatactatctg
gatctacacattcaccagaaactagttctgagaaaccagaggatatagataattttaattgctcgtcggtattcgaaatcgcgactccggaa
ccaattactgataatgtagaagatcatacagacaccgtcacatacactagtgatagcattaatacagtaagtgcatcatctggagaatccac
aacagacgagactccggaaccaattactgataaagaagaagatcatacagtcacagacactgtctcatacactacagtaagtacatcatc
tggaattgtcactactaaatcaaccaccgatgatgcggatctttatgatacgtacaatgataatgatacagtaccaccaactactgtaggcg
gtagtacaacctctattagcaattataaaaccaaggactttgtagaaatatttggtattaccgcattaattatattgtcggccgtggcaatatt
ctgtattacatattatatatataataaacgttcacgtaaatacaaaacagagaacaaagtctagattttgacttacataaatgtctgggata
gtaaaatctatcatattgagcggaccatctggttcaggaaagacagccatagccaaaagactatgggaatatatttggatttgtggtgtccc
ataccactagatttcctcgtcctatggaacgagaaggtgtcgattaccattacgttaacagagaggccatctggaagggaatagccgccgg
aaactttctagaacatactgagttttaggaaatatttacggaacttctaaaactgctgtgaatacagcggctattaataatcgtatttgtgtg
atggatctaaacatcgatggcgttagaagtcttaaaaatacgtacctaatgccttactcggtgtatataagacctacctctcttaaaatggtt
gagaccaagcttcgttgtagaaacactgaagcggatgatgagattcatcgtcgtgtgatgttggcaaaaactgacatggatgaggcaggtg
aagccggtctattcgacactattatcattgaagatgatgtgaatttagcatatagtaagttaattcagatactacaggaccgtattagaatgta
ttttaacactaattagagacttaagacttaaaacttgataattaataatataactcgtttttatatgtggctatttcaacgtctaatgtattagtta
aatattaaaacttaccacgtaaaacttaaaatttaaaatgatatttcattgacagatagatcacacattatgaactttcaaggacttgtgttaa
ctgacaattgcaaaaatcaatgggtcgttggaccattaataggaaaaggtggattcggtagtatttatactactaatgacaataattatgta
gtaaaaatagagcccaaagctaacggatcattatttaccgaacaggcattttatactagagtacttaaaccatccgttatcgaagaatggaa
aaaatctcacaatatataaagcacgtaggtcttatcacgtgcaaggcatttggtctatacaaatccattaatgtggaatatcgattcttggtaatt
aatagattaggtgcagatctagatgcggtgatcagagccaataataatagattaccaaaaaggtcggtgatgttgatcggaatcgaaatct
taaataccatacaatttatgcacgagcaaggatattctcacggagatattaaagcgagtaatatagtcttggatcaaatagataagaataa
attatatctagtggattacggattggtttctaaattcatgtctaatggcgaacatgttccatttataagaaatccaaataaaatggataacggt
actctagaatttacacctatagattcgcataaaggatacgttgtatctagacgtggagatctagaaacacttggatattgtatgattagatgg
ttgggaggtatcttgccatggactaagatatctgaaacaaagaattgtgcattagtaagtgccacaaaacagaaatatgttaacaatactg
cgactttgttaatgaccagtttgcaatatgcacctagagaattgctgcaatatattaccatggtaaactctttgacatattttgaggaacccaa
ttacgacgagtttcggcacatattaatgcaggtgtatattattaagtgtggtgtttggtcgatgtaaaattttttgtcgataaaaattaaaaaat
aacttaatttattattgatctcgtgtgtacaaccgaaatcatggcgatgtttacgcacacgctctcggtgggtacgacgagaatcttcatgcc
tttcctggaatatcatcgactgttgccaatgatgtcaggaaatattctgttgtgtcagtttataataacaagtatgacattgtaaaagacaaat
atatgtggtgttacagtcaggtgaacaagagatatattggagcactgctgcctatgtttgagtgcaatgaatatctacaaattggagatccg
atccatgatcaagaaggaaatcaaatctctatcatcacatatcgccacaaaaactactatgctctaagcggaatcgggtacgagagtctag
acttgtgtttggaaggagtagggattcatcatcacgtacttgaaacaggaaacgctgtatatggaaaagttcaacatgattattctactatca
aagagaaggccaaagaaatgaatgcactcagttcaggacctatcatcgattaccacgtctggataggagattgtatctgtcaagttactgct
gtggacgtacatggaaaggaaattatgagaatgagattcaaaaagggtgcggtgctacagatcccaaatctggtaaaagttaaacttggg
gagaatgatacagaaaatctttcttctactatatcggcggcaccatcgaggtaaccacctctcaagaagaccgcgtgaataatgtactcatg
aaacgtttggaaactatacgccatatgtggtctgttgtatatgatcattttgatattgtgaatggtaaagaatgctgttatgtgcatacgcattc
atctaatcaaaatcctataccgagtactgtaaaaacaaatttgtacatgaagactatgggatcatgcattcaaatggattccatggaagctc
tagagtatcttagcgaactgaaggaatcaggtggatggagtcccagaccagaaatgcaggaatttgaatatccagatggagtggaagaca
ctgaatcaattgagagattggtagaggagttcttcaatagatcagaacttcaggctggtaaattagtcaaatttggtaattctattaattgtta
aacatacatctgtttcagctaagcaactaagaacacgtatacggcagcagcttcctttttatactctcatcttttaccaacacaaagggtggat
atttgttcattggagttgataataatacacacaaagtatttggattcacggtgggttacgactacctcagactgatagagaatgatatagaaa

FIG. 12AO agcatatcaaaagactttgtgttgtgcatttctgtgagaagaaagaggacatcaagtacacgtgtcgattcatcaaggtatataaacctggg gatgaggctacctcgacatacgtgtgcgctatcaaagtggaaagatgctgttgtgctgtgtttgcagattggccagaatcatggtatatggat actaatggtatcaagaagtattctccagatgaatgggtgtcacatatataaatttaattaatgtaactatagagaacaaataataggttgta atatcatatagacaataactaacaattaattagtaactgttatctcttttttaactaaccaactaactatataccttattaatacatcgtaattat agttcttaacatctattaatcattgattcgcttctttaattttttataaactaacattgttaattgaaaagggataacatgttacagaatataaatt atatatggatttttttaaaaaggaaatacttgactggagtgtatatttatctcttcattatatagcacgcgtgtgttccaattcttccacatcccat ataatacaggattataatctcgttcgaacatacgagaaagtggataaaacaatagttgatttttttatctaggttgccaaatttattccatatttt agaatatggggaaaatattctacatatttattctatggatgatgctaatacgaatattataattttttttctagatagagtattaaatattaataa gaacgggtcatttatacacaatctcaggttatcatcatccattaatataaaagaatatgtatatcaattagttaataatgatcatccagataat aggataagactaatgcttgaaaatggacgtagaacaagacattttttgtcctatatatcagatacagttaatatctatatatgtattttaataa atcatggattttatatagatgcagaagacagttacggttgtacattattacatagatgtatatatcactataagaaatcagaatcagaatcat acaatgaattaattaagatattgttaaataatggatccgatgtagataaaaaagatacgtacggaaacacaccttttatcctattatgtaaac acgatatcaacaacgtggaattgtttgagatatgtttagagaatgctaatatagactctgtagactttaatagatatacacctcttcattatgtc tcatgtcgtaataaatatgattttgtaaagttattaatttctaaaggagcaaatgttaatgcgcgtaataaattcggaactactccattttattgt ggaattatacacggtatctcgcttataaaactatatttggaatcagacacagagttagaaatagataatgaacatatagttcgtcatttaata atttttgatgctgttgaatcttttagattatctattatccagaggagttattgatattaactatcgtactatatacaacgaaacatctatttacgac gctgtcagttataatgcgtataatacgttggtctatctattaaacagaaatggtgattttgagacgattactactagtggatgtacatgtatttc ggaagcagtcgcaaacaacaacaaaataataatggaagtactattgtctaaacgaccatctttgaaaattatgatacagtctatgatagca attactaaaaataaacaacataatgcagatttattgaaaatgtgtataaaatatactgcgtgtatgaccgattatgatactcttatagatgta cagtcgctacagcaatatataaatggtatattttaaaatgtttcgatgaaatagatatcatgaagagatgttatataaaaaataaaactgtattc caattagttttttgtatcaaagacattaatactttaatgagatatggtaaacatccttctttcgtgaagtgcactagtctcgacgtatacggaag tcgtgtacgtaatatcatagcatctattagatatcgtcagagattaattagtctattatccaagaagctggatgcgggagataaatggtcgtg ttttcctaacgaaataaaatataaaatattggaaaactttaacgataacgaactatccacatatctaaaaatcttataaacactattaaaat ataaaatcaagtaggataaaatcacactacatcattgtttcctttttagtgctcgacagtgtatactattttttaacactcataaataaaaatga aaacgatttccgttgttacgttgttatgcgtactacctgctgttgtttattcaacatgtactgtacccactatgaataacgctaaattaacgtcta ccgaaacatcgtttaatgataaacagaaagttacatttacatgtgatcagggatatcattctttggatccaaatgctgtctgcgaaacagata aatggaaatacgaaaatccatgcaagaaaatgtgcacagtttctgattatgtctctgaattatatgataagccattatacgaagtgaattcc accatgacactaagttgcaacggcgaaacaaaatattttcgttgcgaagaaaaaaatggaaatacttcttggaatgatactgttacgtgtcc taatgcggaatgtcaacctcttcaattagaacacggatcgtgtcaaccagttaaagaaaaatactcatttggggaatatatgactatcaact gtgatgttggatatgaggttattggtgcttcgtacataagttgtacagctaattcttggaatgttattccatcatgtcaacaaaaatgtgatata ccgtctctatctaatggattaaatttccggatctacattttctatcggtggcgttatacatcttagttgtaaaagtggttttatactaacgggatctc catcatccacatgtatcgacggtaaatggaatcccatactcccaacatgtgtacgatctaacgaaaaatttgatccagtggatgatggtccc gacgatgagacagatttgagcaaactctcgaaagacgttgtacaatatgaacaagaaatagaatcgttagaagcaacttatcatataatca tagtggcgttaacaattatgggcgtcatattttttaatctccgttatagtattagtttgttcctgtgacaaaaataatgaccaatataagttccata aattgctaccgtaaatataaatccgttaaaataattaataatttaataacaaacaagtatcaaaagattaaagacttatagctagaatcaat tgagatgtcttcttcagtggatgttgatatctacgatgccgttagagcattttactcaggcactattataacaagagatttattgtgtatggaa gaagtaacgccatattacataatatatacaggctatttacaagatgcgccgttataccgttcgatgatatagtacgtactatgccaaatgaat cacgtgttaaacaatgggtgatggatacacttaatggtataatgatgaatgaacgcgatgtttctgtaagcgttggcaccggaatactattc atggaaatgttttcgattacaataaaaatagtatcaacaatcaactaatgtatgatataattaatagcgtatctataattctagctaatgaga gatatagaagcgctttttaacgacgatggtatatacatccgtagaaatatgattaacaagttgtacggatacgcatctctaactactattggca cgatcgctgcaggtgtttgttattatctgttgatgcatctcagttagtttgtataaataattatttcaatatactagttaaaattttaagattttaaat gtataaaaaactaataacgtttttatttgtaataggtgcattagcatcctattcgaataatgagtacactccgtttaataaactgagtgtaaaa ctctatatagatggagtagataatatagaaaattcatatactgatgataataatgaattggtgttaaattttaaagagtacacaatttctatta ttacagagtcatgcgacgtcggatttgattccatagatatagatgttataaacgactataaaattattgatatgtataccattgactcgtctact

FIG. 12AP attcaacgcagaggtcacacgtgtagaatatctaccaaattatcatgccattatgataagtacccttatattcacaaatatgatggtgatgag caacaatattctattactgcagagggaaaatgctataaaggaataaaatatgaaataagtatgatcaacgatgatactctattgagaaaac atactcttaaaattggatctacttatatatttgatcgtcatggacatagtaatacatattattcaaaatatgattttttaaaaatttaaaatatatt atcacttcagtgacagtagtcaaataacaaacaacaccatgagatatattataattctcgcagttttgttcattaatagtatacacgctaaaat aactagttataagtttgaatccgtcaattttgattccaaaattgaatggactggggatggtctatacaatatatcccttaaaaattatggcatc aagacgtggcaaacaatgtatacaaatgtaccagaaggaacatacgacatatccgcatttccaaagaatgatttcgtatctttctgggttaa atttgaacaaggcgattataaagtggaagagtattgtacgggactatgcgtcgaagtaaaaattggaccaccgactgtaacattgactgaa tacgacgaccatatcaatttgtacatcgagcatccgtatgctactagaggtagcaaaaagattcctatttacaaacgcggtgacatgtgtga tatctacttgttgtatacggctaacttcacattcggagattctaaagaaccagtaccatatgatatcgatgactacgattgcacgtctacaggt tgcagcatagactttgtcacaacagaaaaagtgtgcgtgacagcacagggagccacagaagggtttctcgaaaaaattactccatggagt tcgaaagtatgtctgacacctaaaaagagtgtatatacatgcgcaattagatccaaagaagatgttcccaatttcaaggacaaaatggcca gagttatcaagagaaaatttaataaacagtctcaatcttatttaactaaatttctcggtagcacatcaaatgatgttaccacttttcttagcatg cttaacttgactaaatattcataactaattttattaatgatacaaaaacgaaataaaactgcatattatacactggttaacgcccttataggc tctaaccattttcaagatgaggtccctgattatagtccttctgttcccctctatcatctactccatgtctattagacgatgtgagaagactgaag aggaaacatgggggattgaaaataggggttgtgtataattgccaaagatttctatcccgaaagaactgattgcagtgttcatctcccaactgca agtgaaggattgataactgaaggcaatggattcagggatatacgaaacaccgatataattataaaaaaagcaatgtgtccgctgtttccgtt aataatactattttcgtaactggcggattattcataaataactctaatagcacgatcgtggttaacaatatggaaaaacttgacatttataaa gacaaacaatggtcgattatagaaatgcctatggctagggtatatcacggcatcgactcgacatttggaatgttatattttgccggaggtcta tccgttaccgaacaatatggtaatttagagaaaaacaacgagatatcttgttacaatcctagaacgaataagtggtttgatatttcatatact atttataagatatccatatcatcattgtgtaaactaaataacgtcttctatgtatttagtaaggacattggatatgtggaaaagtatgatggtg catggaagttagtacatgatcgtctccccgctataaaggcattatcaacttctccttattgattgaaaatgaaaatataaatagtttttatgtat agcagtattaccctatagtttattgcttactactaacatggatacagatgttacaaatgtagaagatatcataaatgaaatagatagagaga aagaagaaatactaaaaaatgtagaaattgaaaataataaaaacattaacaagaatcatccaagtggatatattagagaagcactcgtta ttaatacaagtagtaatagtgattccattgataaagaagttatagaatgtatcagtcacgatgtaggaatatagatcatatctactaattttta taatcgatacaaaacataaaaaacaactcgttattacatagcaggcatggaatccttcaagtattgtttgataacgatggcaagaaatgg attatcggaaatactttatattctggtaattcaatactatataaggtcagaaaaaatttcactagttcgttctacaattacgtaatgaaaatag atcacaaatcacacaagccattgttgtctgaaatacgattctatatatctgtattggatcctttgactatcgacaactggacacgggaacgtg gtataaagtatttggctattccagatctgtatggaattggagaaaccgatgattatatgttcttcgttataaagaattcgggaagagtattcgc cccaaaggatactgaatcagtcttcgaagcatgcgtcactatgataaacacgttagagtttatacactctcgaggatttacccatggaaaaa tagaaccgaggaatatactgattagaaataaacgtctttcactaattgactattctagaactaacaaactatacaagagtggaaactcacat atagattacaacgaggacatgataacttcaggaaatatcaattatatgtgtgtagacaatcatcttggagcaacagtttcaaaacgaggag atttagaaatgttgggatattgcatgatagaatggttcggtggcaaacttccatggaaaaacgaaagtagtataaaagtaataaaacaaa aaaaagaatataaaaaatttatagctactttctttgaggactgttttcctgaaggaaatgaacctctggaattagttagatatatagaattagt atacacgttagattattctcaaactcctaattatgacagactacgtaaactgtttatacaagattgaaattatattctttttttatagagtgtggt agtgttacggatatctaatattaatattagactatctctatcgcgctacacgaccaatatcgattactatggatatcttcagggaaatcgcatc ttctatgaaaggagagaatgtattcatttctccagcgtcaatctcgtcagtattgacaatactgtattatggagctaatggatccactgctgaa cagctatcaaaatatgtagaaacggaggagaacacggataaggttagcgctcagaatatctcattcaaatccatgaataaagtatatggg cgatattctgccgtgtttaaagattccttttttgagaaaaattggcgataagtttcaaactgttgacttcactgattgtcgcactatagatgcaat caacaagtgtgtagatatctttactgaggggaaaatcaatccactattggatgaaccattgtctcctgatacctgtctcctagcaattagtgc cgtatactttaaagcaaaatggttgatgccattcgaaaaggaatttaccagtgattatccctttttacgtatctccgacggaaatggtagatgt aagtatgatgtctatgtacggcaaggcatttaatcacgcatctgtaaaggaatcattcggcaacttttcaatcatagaactgccatatgttgg agatactagtatgatggtcattcttccagacaagattgatggattagaatccatagaacaaaatctaacagatacaaattttaagaaatggt gtaactctctggaagctacgtttatcgatgttcacattcccaagtttaaggtaacaggttcgtataatcttgtggatactctagtaaagtcagg actgacagaggtgttcggttcaactggagattatagcaatatgtgtaattcagatgtgagtgtcgacgctatgattcacaaaacgtatataga

FIG. 12AQ tgtcaatgaagagtatacagaagcagctgcagcaacttgtgcactggtgtcagactgtgcatcaacaattacaaatgagttctgtgtagatc
atccgttcatctatgtgattaggcatgttgatggaaaaattcttttcgttggtagatattgctctccgacaactaattgttaaccattttttttaaa
aaaatagaaaaaacatgtggtattagtgcaggtcgttgttcttccaattgcaattggtaagatgacggccaactttagtacccacgtcttttca
ccacagcactgtggatgtgacagactgaccagtattgatgacgtcagacaatgtttgactgaatatatttattggtcgtcctatgcataccgc
aacaggcaatgcgctggacagttgtattccacactcctctcttttagagatgatgcggaatcagtgttcatcgacattcgcgagctggtaaaa
aatatgccgtgggatgatgtcaaagattgtacagaaatcatccgttgttatataccggatgagcaaaaaaccatcagagagatttcggcca
tcatcggactttgtgcatatgctgctacttactggggaggtgaagaccatcccactagtaacagtctgaacgcattgtttgtgatgcttgagat
gctcaattacgtggattataacatcatattccggcgtatgaattgatgagttgtacatcttgacattttctttcttctcttctcccttcttctcttct
cccttcctccctcttctcccttcccagaaacaaacttttttacccactataaaataaaatgagtatactacctattatatttcttcctatattttttt
attcttcattcgttcagacttttaacgcgcctgaatgtatcgacaaagggcaatattttgcatcattcatggagttagaaaacgagccagtaat
cttaccatgtcctcaaataaatacgctatcatccggatataatatattagatattttatgggaaaaacgaggagcggataatgatagaattat
accgatagataatggtagcaatatgctaattctgaacccgacacaatcagactctggtatttatatatgcattaccacgaacgaaacctact
gtgacatgatgtcgttaaatttgacaatcgtgtctgtctcagaatcaaatatagatcttatctcgtatccacaaatagtaaatgagagatctac
tggcgaaatggtatgtcccaatattaatgcatttattgctagtaacgtaaacgcagatattatatggagcggacatcgacgccttagaaata
agagacttaaacaacggacacctggaattattaccatagaagatgttagaaaaaatgatgctggttattatacatgtgttttagaatatatat
acagaggtaaaacatataacgtaaccagaattgtaaaattagaggtacgggataaaataataccttctactatgcaattaccagatggcat
tgtaacttcaataggtagtaatttgactattgcgtgtagagtatcgttgagacctcccacaacggatgcagacgtctttggataagtaatggt
atgtattacgaagaagatgatgggggacggagacggtagaataagtgtagcaaataaaatctatatgaccgataagagacgtgttattaca
tcccggttaaacattaatcctgtcaaggaagaagatgctacaacgtttacgtgtatggcgtttactattcctagcatcagcaaaacagttact
gttagtataacgtgaatgtatgttgttacatttccatgtcaattgagtttataagaatttttatacattatcttccaacaaacaattgacgaacgt
attgctatgattaactcccacgatactatgcatattattaatcattaacttgcagactatacctagtgctattttgacatactcatgttcttgtgta
attgcggtatctatattattaaagtacgtaaatctagctatagtttttattatttaattttagataatataccgtctccttattttttaaaaattgccac
atcctttattaaatcatgaatgggaatttctatgtcatcgttagtatattgtgaacaacaagagcagatatctataggaaagggtggaatgcg
atacattgatctatgtagttttaaaacacacgcgaactttgaagaatttatataaatcattccatcgatacatccttctatgttgacatgtatat
atccaggaattcttttattaatgtcaggaaatgtatataactaaaacattgcccgaaagcggtgcctctatctgcgttatatccgttcttaactta
caaaatgtaaccaataccctttgcatgacttgtttgttcggcaacgttagtttaaacttgacgaatggattaattacaatagcatgatccgcgc
atctattaagttttttttactttaacgcccttgtatgttttttacagagactttatctaaatttctagtacttgtatgtgttataaatataacgggatat
agaactgaatcacctaccttagatacccaattacattttatcagatccagataataaacaaattttgtcgccctaactaattctatattgttata
tattttacaattggttatgatatcatgtaataacttggagtctaacgcgcatcgtcgtacgtttatacaattgtgatttagtgtagtatatctaca
catgtattttccgcactatagtattctggactagtgataaaactatcgttatatctgtcttcaatgaactcatcgagatattgctctctgtcatat
tcatacacctgcataaactttctagacatcttacaatccgtgttattttaggatcatatttacatatttacgggtatatcaaagatgttagattag
ttaatgggaatcgtctataataatgaatattaaacaattatatgaggacttttaccacaaagcatcataaaaatgagtcgtcgtctgatttatg
ttttaaatatcaaccgcaaatcaactcataaaatacaagagaatgaaatatatacatattttagtcattgcaatatagaccatacttctacag
aacttgatttgtagttaaaaactatgatctaaacagacgacaacatgtaactgggtatactgcactacactgctatttgtataataattactt
tacaaacgatgtactgaagatattattaaatcatgacgtaaatgtaacgatgaaaaccagtagcggacgtatgcctgtttatatattgcttac
tagatgttgcaatattcacatgatgtagtgatagatatgatagacaaagataaaaaccacttattacatagagactattccaacctattact
agagtatataaaatctcgttacatgttattaaaggaagaggatatcgatgagaacatagtatccactttattagataagggaatcgatccta
actttaaacaagacggatatacagcgttacattattattatttgtgtctcgcacacgtttataaaccaggtgagtgtagaaaaccgataacga
taaaaaaggccaagcgaattatttctttgtttatacaacatggagctaatctaaacgcgttagataattgtggtaatacaccattccatttgta
tcttagtattgaaatgtgtaataatattcatatgactaaaatgctgttgacttttaatccgaatttcaaaatatgtaataatcatggattaacgc
ctatactatgttatataacttccgactacatacaacacgatattcttgttatgttaatacatcactatgaaacaaatgttggagaaatgccgat
agatgagcgtcgtatgatcgtattcgagtttatcaaaacatattctacacgtccggcagattcgataacttatttgatgaataggtttaaaaat
ataaatatttatacccgctatgaaggaaagacattattacacgtagcatgtgaatataataatacacacgtaatagattatcttatacgtatc
aacggagatatataaatgcgttaaccgacaataacaaacacgctacacaactcattatagataacaaagaaaattccccgtataccatcgatt

FIG. 12AR gtttactgtatatacttagatatattgtagataagaatgtgataagatcgttggtggatcaacttccatctctacctatcttcgatataaaatca
tttgagaaattcatatcctactgtatacttttagatgacacattttacgataggcacgttaagaatcgcgattctaaaacgtatcgatacgcatt
ttcaaaatacatgtcgtttgataaatacgatggtataataactaaatgtcacgacgaaacaatgttactcaaactgtccactgttctagacac
tacactatatgcagttttaagatgccataattcgaaaaagttaagaagatacctcaacgagttaaaaaaatataataacgataagtccttta
aaatatattctaatattatgaatgagagataccttaatgtatattataaagatatgtacgtgtcaaaggtatatgataaactatttcctgttttc
acagataaaaattgtctactaacattactaccttcagaaattatatacgaaatattatacatgctgacaattaacgatctttataatatatcgt
atccacctaccaaagtatagttgtattttttctcatgcgatgtgtgtaaaaaaactgatattatataaatattttagtgccgtataataaagatga
cgatgaaaatgatggtacatatatatttcgtatcattattgttattgctattccacagttacgccatagacatcgaaaatgaaatcacagaatt
cttcaataaaatgagagatactctaccagctaaagactctaaatggttgaatccagcatgtatgttcggaggcacaatgaatgatatagcc
gctctaggagagccattcagcgcaaagtgtcctcctattgaagacagtctttatcgcacagatataaagactatgtggttaaatgggagag
gctagaaaagaatagacggcgacaggtttctaataaacgtgttaaacatggtgatttatggatagccaactatacatctaaattcagtaacc
gtaggtatttgtgtaccgtaactacaaagaatggtgactgtgttcagggtatagttagatctcatattaaaaaacctccttcatgcattccaaa
aacatatgaactaggtactcatgataagtatggcatagacttatactgtggaattctttacgcaaaacattataataatataacttggtataa
agataataaggaaattaatatcgacgacattaagtattcacaaacgggaaagaaattaattattcataatccagagttagaagatagtgga
agatacaactgttacgttcattacgacgacgttagaatcaagaatgatatcgtagtatcaagatgtaaaatacttacggttataccgtcgcaa
gaccacaggtttaaactaatactagatccaaaaatcaacgtaacgataggagaacctgccaatataacatgcactgctgtgtcaacgtcat
tattgattgacgatgtactgattgaatgggaaaatccatccggatggcttataggattcgattttgatgtatactctgttttaactagtagaggc
ggtattaccgaggcgaccttgtactttgaaaatgttactgaagaatatataggtaatacatataaatgtcgtggacacaactattattttgaa
aaaacccttacaactacagtagtattggagtaaatacacaatgcattttatatacattactgaataattattattattatttatatcgtatttgt
gctataacgcgactatctaggtatttgtatctcactgatagagaacatataaatatagactctattaaacagttgtgtaaaatatcaaatcct
aatagatgtggatgtacggctttacatgagtactttataattatagatcagtcaacggaaaatacaagtatagatacaacggttactatcaa
tattatttatctagcgattatgaaaattataatgaatattattatgatgattatgatagaactggtatgaacagtgagagtgataatatatcaat
caaaacagaatatgaattctatgatgaaacacaagatcaaagtacacaactagtaggttacgacattaaactcaaaaccaatgaggatga
ttttatggctatgatagatcagtgggtgtccatgattatatagatgaatcaattaataaagtagtatatggaagagagtctcacgtaagatgg
cgggatatatggcaagaacataatgatggcgtatacagtataggaaaggagtgcatagataatatatacgaagacaaccataccgtaga
cgaattctacaagatagacagcgtatcagatgtgagatgacgcggaacacatatctccgataactaatgatgtatctacacaaacatgggaa
aagaaatcagagttagatagatacatggaaatgtatcctcgtcatagatatagtaagcattctgtctttaagggatttctgacaaagttaga
aaaaatgatttagacatgaatgtggtaaaagaattactttctaacggtgcatctctaacaattaaggatagcagtaataaggatccaataa
ccgtttattttcgaagaacgataatgaatttagaaatgattgatattattaacaaacatacaactattgatgaacgaaagtatatagtacact
cctatctaaaaaattataaaaatttcgattatccattttttcaggaagttagtttttgactaataaacattgtctcaacaattattataatataagc
gacagcaaatatggaacaccgctacatatattggcgtctaataaaaaattaataactcctaattacatgaagttattagtgtataacggaaa
tgatataaacgcacgaggtgaagatacacaaatgcgaactccattacacaaatatttgtgtaaatttgtatatcataatattgaatatggtat
ccgatactataatgaaaagattatagacgcatttatagagttaggagccgatctaactattccaaataacgatggaatgataccagtagttt
actgtatacactcaaatgcagaatatggttataacaatattactaacataaagataatacgtaaactacttaatcttagtagacgtgcgtcac
ataatctatttagagatcgagtcatgcacgattatataagtaatacatatattgatcttgagtgtttagatattattagatcgttggatggattcg
atatcaatggttactttgaaggacgtacaccacttcattgcgctatacaacataacttcactcagattgctaagtacttattagatcgaggagc
tgatatagtcgtacccaacacattgattatacatcagtacatacagtaaatagcatagatatggaggaggatacaaatatttcaaataaagt
tataaggtacaacactgtcaataatatatggaagacattacctaacttctggactggaactataaatccaggcgtggtctcgcataaagatg
atatatatgttgtatgcgacatcaaagatgaaaaaaatgttaagacttgtatatttagatataacacgaatacgtataacggatgggaattg
gttacgacgacagaaagcagattatcagctctgcatactattcttcatgacaataccataatgatgttacattgttatgaatcgtatatgttac
aagatacatttaatgtgtacactcgcgaatggaatcatatgtgtcatcaacattcgaatagttatatcatgtacaatatactacccatctacta
aatataatagaataaaataaatgagtatgatcattttagataacgattgatttttatcattaccgcttcattcttatattctttgcttacggaacct
atatttagaaacatctactaacgattttttatgcttgcattattaatggtatgtaatatgattgattgtgtacgcaataccaatttgttaagtatg
aatacggggtacaaacataaactgaaatttaacattatttatttatgatatatatcgttatcgttattgtttggtctataccatggatatctttaa

FIG. 12AS agaactaatcttaaaacaccctgatgaaaatgttttgatttctccagtttctattttatctactttatctattctaaatcatggagcagctggttct acagctgaacaactatcaaaatatatagagaatatgaatgagaatacacccgatgataagaaggatgacaataatgacatggacgtaga tattccgtattgtgcgacactagctaccgcaaataaaatatacggtagcgatagtatcgagttccacgcctccttcctacaaaaaataaaag acgattttcaaactgtaaactttaataatgctaaccaaacaaaggaactaatcaacgaatgggttaagacgatgacaaatggtaaaatta attccttattgactagtccgctatccattaatactcgtatgacagttgttagcgccgtccattttaaagcaatgtggaaatatccattttctaaac atcttacatatacagacaagttttatatttctaagaatatagttaccagtgttgatatgatggtgggtaccgagaataacttgcaatatgtaca tattaatgaattattcggaggattctctattatcgatattccatacgagggaaactctagtatggtaattatactaccggacgacatagaaggt atatataacatagaaaaaaatataacagatgaaaaatttaaaaaatggtgtggtatgttatctactaaaagtatagacttgtatatgccaa agtttaaagtggaaatgacagaaccgtataatctggtaccgatttagaaaatttaggacttactaatatattcggatattatgcagattttag caagatgtgtaatgaaactatcactgtagaaaaatttctacatacgacgtttatagatgttaatgaggagtatacagaagcatcggccgtta caggagtatttatgactaacttttcgatggtatatcgtacgaaggtctacataaaccatccattcatgtacatgattaaagacaacacaggac gtatactttttatagggaaatactgctatccgcaataaaatataaacaaatagacttttatcacgtttatctatgtctaaatattacaaatagta atagtataaactaaagctgataatacttaaaaaaataataatatcatttacaattaatagtataaactaaaaattaaacaaatcgttattata agtaatatcaaaatgatgatatacggattaatagcgtgtcttatattcgtgacttcatccatcgctagtccactttatattcccgttattccaccc attacggaagataaatcgttcaatagtgtagaggtattagtttccttgtttagagatgaccaaaaagactatacggtaacttctcagttcaata actacactatcgataccaaagactggactatcggcgtactatccacacctgatggtttggatataccattgactaatataacttattggtcac ggtttactataggtcgtgcattgttcaaatcagagtctgaggatattttccaaaagaaaatgagtattctaggtgtttctatagaatgtaagaa gtcgtcgacattacttactttttttgaccgtgcgtaaaatgactcgagtatttaataaaatttccagatatggcttattatcgaggagactgtttaa aagccgtttatgtaacaatgacttataaaaatactaaaactggagagactgattacacgtacctctctaatggggggttgcctgcatactat cgtaatggggtcgatggttgattattgattagtatattccttattcacacaaaaagaacattttttataaacatgaaaccactgtctaaatgtaa ttatgatcttgatttatagatgaagatcagcctttagaggattttaaccagtatgtttaatatgaaaaaaataaacataacatattttgagatta agcgctattgtgcttaattattttgctctataaactgaatatatagccacaattattgacgggcttgtttatgaccggcaatcatgaatttacag aaattatctctggctatatatcttactgcgacatgttCgtggtgttatgaaacatgcataagaaaaactgcgttgtatcatgacattcaattgg agcatgtagaagacaataaagatagtgtagcgtcgctaccgtacaagtagtcaatcaaagagaacgtagtagattgttggctacatttaatt ggacagatatagctgagggtgttagaaatgagttcattaaaatatgtgatatcaacggaacatatttatataattatactattgctgttagtat aattattgattccacggaagaactaccaacagttactccaattacaacaacatatgaaccttctacatataattatactatcgatgatagcac tgttattactactgaagaactacaagtgactcctcatatggatctccatcgatgatacatgtattaaaatactttccgaataagtcttttaaata ttgtattaattatgaaaaactatgctatgcgagtatgatgcaaagatgtttaatgatacgatactagattttatctctagcgagagatgtcgtta gaatcatttatcataactacgtttaataataattcatcaacgaatatcgataacatgtgtcatttatacgttaaagtctgtccgtcttctctattg tttagactgtttgtagaatgctgtgatataaacaaactagtagaaggtacgactccgttacactgttatctaatgaatgaaggatttgaatcat ctgttttaaaaaacctattaaaggagtatgtcatgaatacgtttaatgttcatgacatccattacacaaatatttaactcatgatgaagttgag aatgatatgctttctgatagtatagatagctttagctaatataaaaatatattaatccactatatattctagacttgatttaaaaccgataaact actactacgtactgtataagttgttaaaaaaaggagcagaccctaattatgtagatgatagaggtaatactttttcttcattacttctgcatctat atgtccacttatgagaaaacgtcatttaataagatgcatcgtgaaaagaaatttattaaagagttggtaaaatatgaaaccgaaagtaaat aatataggaaatacacctctacataactacgtatctcaatatgatatcactctcattcctcatccacaacccattaaaaaaatggaaattaa agccctctattagcataaacggctacaggtctacctttacaatggcctctccttgtgcccagttcagaccctgtcattgccacgctactaagg actccctgaataccgtggccgacgtcagacattgtctgactgaatacatcctgtgggtttctcatagatggacccatagagaaagcgcagg gtctctctacaggcttctcatctctttcagaactgatgcaacggagctctttggtggtgagttgaaggattcacttccgtgggacaatatcgac aattgcgtggagatcattaaatgtttcatcagaaatgactccatgaaaaccgccgaagaacttcgtgcaatcattggactttgtactcaatca gctatcgtctctggaagagtcttcaacgataagtatatcgacatactacttatgctgcgaaagattctgaacgagaacgactatctcaccctc ttggatcatatccgcactgctaaatactaaatctccttcatgctctctcactacacttttttatcatcttatgaggaatgattgccttcatcatttttc gtgaaataggaataattagcaccagaatagctatggattgcacatgtattctatgtcgtctactggatgaagatgtgacgtacaaaaaaata aaactagaaattgaaacgtgtcacaacttatcaaaacatatagatagacgaggaaacaatgcgctacattgttacgtcttcaataaatgcg atacagacattaagattgttcgactgttactctctcgcggagtcgagagactttgtagaaacaacgaaggattaactccgctaggagcatac

FIG. 12AT agtaagcatagatacgtaaaatctcaaattgtgcatctactgatatccagctattcgaattcctctaacgaactcaagtcgaatatataaatgat
ttcgatctgtattcgtatatgtcttcggataatatcgacttacgtctgctaaaatacctaattgtggataaacggatacgtccgtccaagaata
cgaattatgcaatcaatggtctcggattggtggatatatacgtaacgacgcctaatccgagaccagaagtattgctatggcttcttaaatcag
aatgttacagcaccggttacgtatttcgtacctgtatgtacgacagtgatatgtgtaagaactctcttcattactatatatcgtctcatagagaa
tctcaatctctatccaaggatgtaattaaatgtttgatcaataacaatgtttccatccatggcagagacgaaggaggatctttacccatccaa
tactactggtcttgctcaaccatagatatagagattgttaaattattaataaaggatgtggacacgtgtagagtatacgacgtcagccctata
ttagaggcggattatctaaacaagcgatttagagtaaccccatataatgtagacatggaaatcgttaatcttcttattgagagacgtcatact
cttgtcgacgtaatgcgtagtattacttcttacgattccagagactataaccactacatcatcgataacattctaaagagatttagacaacag
gatgaatccatcgtacaagccatgttgataaactacttacattacggcgatatggtcgttcgatgcatgttagataacggacaacaactatcc
tctgcacgactactttgttaataataatctcgtcgatgtaaacgtcgtaaggtttatcgtggaaaataatggacacatggctgtaaatcacgt
atcgaacaatggccgtctatgtatgtacggtctgatattatcgagatttaataattgcgggtatcactgttatgaaaccatactaatagatgta
tttgatatactaagcaagtacatggataatatagatatgatcgataatgagaataaaactctactatattacgcggtcgatgtcaataatata
caatttgcaaagcggttattggaatatggagcgagtgttacaacatcacgctcgataatcaatacggccatccagaaaagtagttacagaa
gagaaaacaaaacgaggatagttgatttattacttagctaccatcccactctagagactatgattgacgcatttaatagagatatacgctatc
tatatcctgaaccattattcgcctgtatcagatacgccttaatcctagatgatgattttccttctaaagtaagtatgatatctccggtcgtcataa
ggaactaaagcgctatagagtagacattaatagaatgaagaatgcctacatatcaggcgtctccatgtttgatatattatttaaacgaagca
aacgccacagattgagatacgcaaagaatccgacatcaaatggtacaaaaaagaactaacgtccatcattacagaaactgtaaagaaca
atgagaggatcgactccatagtggacaacattaatacagacgataacttgatttcgaaattacccatggagatactttattactccattaaat
aatttatcatggagcgataatgtcctgtttcatttgtttccatgacatattacaaaatcgattccgtccaagatgataaaaacatttaccggcat
cataaacacggagtttattttatatgtctcgcataaacattactaaaaaaatatattgttcTgTttttctttcacatctttaattatgaaaaagta
aatcattatgagatggacgagattgtacgcatcgttcgcgacagtatgtggtacatacctaacgtatttatggacgacggtaagaatgaagg
tcacgtttctgtcaacaatgtttgtcatatgtattttacgttctttgatgtggatacatcgtctcatctgtttaagctagttattaaacactgcgatc
tgaataaacgaggtaactctccattacattgctatacgatgaatacacgatttaatccatctgtattaaagatattgttacaccacggcatgc
gtaactttgatagcaaggatgaaaaaggacatattcctctacaccactatctgattcattcactatcaatcgataacaagatctttgatatact
aacggacaccattgatgactttagtaaatcatccgatctattgctgtgttatcttagatataaattcaatgggagcttaaactattacgttctgt
acaaaggatccgaccctaattgcgtcgacgaggatggactcacttctcttcattactactgtaaacacatatccacgttctacaaaagcaatt
attacaagttaagtcacactaagatgcgagccgagaagcgattcatctacgcgataatagattatggagcaaacattaacgcggttacaca
cttaccttcaacagtataccaaacatagtcctcgtgtggtgtatgctcttttatctcgaggagccgatacgaggatacgtaataatcttgattgt
acacccatcatggaacgattgtgcaacaggtcatattctcataatgttactcaattggcacgaacaaaaggaagaaggacaacatctactt
tatctattcataaaacataatcaaggatacactctcaatatactacggtatctactagataggttcgacattcagaaagacgaatactataat
accgcctttcaaaattgtaacaacaatgttgcctcatacatcggatacgacatcaaccttccgactaaagacggtattcgacttggtgtttga
aaacagaaacatcatatacaaggcggatgttgtgaatgacatcatccaccacagactgaaagtatctctacctatgattaaatcgttgttct
acaagatgTCTCTCCCTACGACGATTACTACGTAAAAAAGATACTAGCCTACTGCCTATTAAGGGACGAGTCAT
TCGCGGAACTACATAGTAAATTCTGTTTAAACGAGGACTATAAAAGTGTATTTATGAAAAATATATCATTCGA
TAAGATAGATTCCATCATCGTGACATAAGTCGCCTTAAAGAGATTCGAATCTCCGACACCGACCTGTATACG
GTATCACAGCTATCTTAAAGCCATACATTCAGACAGTCACATTTCATTTCCCATGTACGACGATCTCAAACCC
GTACCCAGAAATACCTTTAACTATATCGATGTGGAAATTAATCTGTATCCCGTCAACGACACATCGTGTACTC
GGACGACCACTACCGGTCTCAGCGAATCCATCTCAACGTCGGAACTAACTATTACTATGAATCATAAAGACT
GTAATCCCGTCTTTCGTGATGGATACTTCTCCGTTCTTAATAAGGTAGCAACTTCAGGATTCTTTACAGGAG
AAAGGTGTGCACTCTGAATTTCGAGATTAAATGCAATAACAAAGATTCTTCCTCCAAACAGTTAACGAAAG
CAAAGAATGATACTATCATGCCGCATTCGGAGACAGTAACTCTAGCGTCGACATCTATATACTATATAGTAATA
CCAATACTCAAGACTACGAAACTGATACAATCTCTTATCATGTGGGTAATGTAGCCATATGCCCGGTAGTTGC
GATATACATAAACTGATCACTAATTCCAAACCCACCCGCTTTTTATAGTAAGTTTTTCACCCATAAATACAATA
ATTAATTTCTCGTAAAAGTAGAAAATATATTCTAATTTATTGCACGGTAAGGAAGTAGAATCATAAAGAACAG

FIG. 12AU

TACTCAATCAATAGCAATCATGAAACAATATATCGTACTGGCATGCATGTGCCTGCCAGTCTTCAGCAATCAT
CCTCATCGTGTACGGAAGAAGAAAACAAACATCATATGGGAATCGATGTTATTATCAAAGTCACAAAGCAA
GACCAAACACCGACCGATGATAAGATTTGCCAATCCGTAACGGAAATTACAGAGTCCGAGTCAGATCCAG
ATCCCGAGGTGGAATCAGTCGAGGATGTAGATCCTCCTACCACTTATTACTCCATCATCGGTGGAGGTCTGA
GAATGAACTTTGGATTCACCAAATGTCCTCAGATTAAATCCATCTCAGAATCCGCTGATGGAAAGACTGTGA
GGTGTCTATCGACATCAGATGTAGCGAAGAAGAGAAAGACAGCGACATCAAGACCCATCCAGTACTCGGG
TCTAACATCTCTCATAAGAAAGTGAGTTACGAAGATATCATCGGTTCAACGATCGTCGATACAAAATGTGTC
AAGAATCTAGAGTTTAGCGTTCGTATCGGAGACATGTGCAAGGAATCATCTGAACTTGAGGTCAAGTATGT
CGACGGATCGGCATCTGAAGGTGCAACCGATGATACTTCACTCATCGATTCAACAAAACTCAAAGCGTGTG
TCTGAATCGATAACTCTATTCATCTGAAATTGGATGAGTAGGGTTAATCGAACGATTCAGGCACACCACGAA
TTAAAAAAGTGTACCGGACACTATATTCCGGTTTGCAAAACAAAAAGTTACCTCTCGCGACTTCTTCTTTTT
CTGTCTCAATAGTGTGATACGATTATGACACTATTCCTATTCCTATTTCCTTTCAGGGTATCACAAAAATATTAA
ACCTCTTTCTGATGGTCTCATAAAAAAAGTTTTACAAAAATATTTTTTATTCTCTTTCTCTCTTTGATGGTCT
CATAAAAAAAGTTTTACAAAAATATTTTTATTCTCTTTCTCTCTTTGATGGTCTCATAAAAAAAGTTTTACAAA
AATATTTTTATTCTCTTTCTCTCTTTGATGGTCTCATAAAAAAAGTTTTACAAAAATATTTTTATTCTCTTTCTCT
CTTTGATGGTCTCATAAAAAAAGTTTTACAAAAATATTTTTATTCTCTTTCTCTCTTTGATGGTCTCATAAAAA
AAGTTTTACAAAAATATTTTTATTCTCTTTCTCTCTTTGATGGTCTCATAAAAAATATTAAACCTCTTTCTGATG
GTGTCACTAAAATATTTTTATTCTCATTCTCATTTTCTCTTTCTCTCTTCAATGGAGTCATAAAATATTTTTATTC
TCTTTCTCTCTTCGATGGTCTCACAAAAATATTAAACCTCTTTCTGATGGTGTCACTAAAATATTTTTATTCTCA
TTCTCATTTTCTCTTTCTCTCTTCAATGGAGTCATAAAATATTTTTATTCTCTTTCTCTCTTCGATGGTCTCACA
AAAATATTAAACCTCTTTCTGATGGAGTCGTAAAAAAGTTTTATCTCTTTCTCTCTTCGATGGTCTCACTAAA
ATATTTTTATTCTCTTTCTGATGCATCAACTATTTCTTAAACAATAACGTCCAACAACATATACTCGTCGAGCT
TATCAACATCCCCTATGCCCATCTAGGTTACCAGACAATTGTATATCATAAAATAATGTTTATAATTTACACGTT
AAAATCATATAATAAAACGTAGATCGTATAATATTTTTTGGTATATAAATGATCTAGTAAAATCCATGTAGGGG
ATACTGCTCACATTTTTTCTTTGGTACAAAATTTCACACAAGTTTTTATACAGACAAATTCTTGTCCATATATT
TTAAAACATTGACTTTTGTACTAAGAAAAATATCTAGACTAACTATCTCTTTCTCTTTCTCTCTTCGATGGTCT
CACAAAAATATTAAACCTCTTTCTGATGGAGTCGTAAAAAAGTTTTATCTCTTTCTC 3'

FIG. 13A

>Gene1:266..541, 276 bp atgtcgttagaatcatttatcataactacgtttaataataattcatcaacgaatatcgataacatgtgtcatttatacgttaaagtctgtccgtcttctctat
tgtttagactgtttgtagaatgctgtgatataaacaaactagtagaaggtacgactccgttacactgttatctaatgaatgaaggatttgaatcatctgtt
ttaaaaaacctattaaaggagtatgtcatgaatacgtttaatgttcatgacatccattacacaaatatttaa 116

>Gene2:880..1425, 546 bp atgatatcactctcattcctcatccacaacccattaaaaaaatggaaattaaagccctctattagcataaacggctacaggtctacctttacaatggcct
ctccttgtgcccagttcagaccctgtcattgccacgctactaaggactccctgaataccgtggccgacgtcagacattgtctgactgaatacatcctgtg
ggtttctcatagatggacccatagagaaagcgcagggtctctctacaggcttctcatctctttcagaactgatgcaacggagctctttggtggtgagttg
aaggattcacttccgtgggacaatatcgacaattgcgtggagatcattaaatgtttcatcagaaatgactccatgaaaaccgccgaagaacttcgtgc
aatcattggactttgtactcaatcagctatcgtctctggaagagtcttcaacgataagtatatcgacatactacttatgctgcgaaagattctgaacgag
aacgactatctcaccctcttggatcatatccgcactgctaaatactaa >Gene3:928..1101, 174 bp atgggtccatctatgagaaacccacaggatgtattcagtcagacaatgtctgacgtcggccacggtattcagggagtccttagtagcgtggcaatgac
agggtctgaactgggcacaaggagaggccattgtaaaggtagacctgtagccgtttatgctaatagagggctttaa >Gene4:1348..1488, 141 bp atgatgaaggcaatcattcctcataagatgataaaaagtgtagtgagagagcatgaaggagatttagtatttagcagtgcggatatgatccaagagg
gtgagatagtcgttctcgttcagaatctttcgcagcataagtag >Gene5:1472..2455, 984 bp atgattgccttcatcatttttcgtgaaataggaataattagcaccagaatagctatggattgcacatgtattctatgtcgtctactggatgaagatgtgac
gtacaaaaaaataaaactagaaattgaaacgtgtcacaacttatcaaaacatatagatagacgaggaaacaatgcgctacattgttacgtcttcaat
aaatgcgatacagacattaagattgttcgactgttactctctcgcggagtcgagagactttgtagaaacaacgaaggattaactccgctaggagcata
cagtaagcatagatacgtaaaatctcaaattgtgcatctactgatatccagctattcgaattcctctaacgaactcaagtcgaatataaatgatttcgat
ctgtattcgtatatgtcttcggataatatcgacttacgtctgctaaaatacctaattgtggataaacggatacgtccgtccaagaatacgaattatgcaa
tcaatggtctcggattggtggatatatacgtaacgacgcctaatccgagaccagaagtattgctatggcttcttaaatcagaatgttacagcaccggtt
acgtatttcgtacctgtatgtacgacagtgatatgtgtaagaactctcttcattactatatatcgtctcatagagaatctcaatctctatccaaggatgta
attaaatgtttgatcaataacaatgtttccatccatggcagagacgaaggaggatctttacccatccaatactactggtcttgctcaaccatagatatag
agattgttaaattattaataaaggatgtggcacgtgtagagtatacgacgtcagccctatattagaggcggattatctcaaacaagcgatttagagtaa
ccccatataatgtagacatggaaatcgttaatcttcttattgagagacgtcatactcttgtcgacgtaatgcgtagtattacttcttag >Gene6:2345..2509, 165 bp atgtggaaattaatctgtatcccgtcaacgacacatcgtgtactcggacgaccactaagaagtaatactacgcattacgtcgacaagagtatgacgtct
ctcaataagaagattaacgatttccatgtctacattatatggggttactctaaatcgcttgtttag >Gene7:2922..3251, 330 bp atgctcttttatctcgaggagccgatacgaggatacgtaataatcttgattgtacacccatcatggaacgattgtgcaacaggtcatattctcataatgtt
actcaattggcacgaacaaaaggaagaaggacaacatctcactttatctattcataaaacataatcaaggatacactctcaatatactacggtatctact
agataggttcgacattcagaaagacgaatactataataccgcctttcaaaattgtaacaacaatgttgcctcatacatcggatacgacatcaaccttcc
gactaaagacggtattcgacttggtgtttga

FIG. 13B

>Gene8:3088..3321, 234 bp atggagcaaacattaacgcggttacacacttaccttcaacagtataccaaacatagtcctcgtgtggtgtatgctcttttatctcgaggagccgatacga
ggatacgtaataatcttgattgtacacccatcatggaacgattgtgcaacaggtcatattctcataatgttactcaattggcacgaacaaaaggaagaa
ggacaacatctactttatctattcataaaacataa >Gene9:3266..4021, 756 bp atgtctcgcataaacattactaaaaaaatatattgttcggttttcttcacatctttaattatgaaaaagtaaatcattatgagatggacgagattgtacg
catcgttcgcgacagtatgtggtacatacctaacgtatttatggacgacggtaagaatgaaggtcacgtttctgtcaacaatgtttgtcatatgtatttta
cgttctttgatgtggatacatcgtctcatctgtttaagctagttattaaacactgcgatctgaataaacgaggtaactctccattacattgctatacgatga
atacacgatttaatccatctgtattaaagatattgttacaccacggcatgcgtaactttgatagcaaggatgaaaaaggacatattcctctacaccact
atctgattcattcactatcaatcgataacaagatctttgatatactaacggacaccattgatgactttagtaaatcatccgatctattgctgtgttatctta
gatataaattcaatgggagcttaaactattacgttctgtacaaaggatccgaccctaattgcgtcgacgaggatggactcacttctcttcattactactgt
aaacacatatccacgttctacaaaagcaattattacaagttaagtcacactaagatgcgagccgagaagcgattcatctacgcgataatagattatgg
agcaaacattaacgcggttacacacttaccttcaacagtataccaaacatag >Gene10:3791..4030, 240 bp atgagacgatgtatccacatcaaagaacgtaaaatacatatgacaaacattgttgacagaaacgtgaccttcattcttaccgtcgtccataaatacgtt
aggtatgtaccacatactgtcgcgaacgatgcgtacaatctcgtccatctcataatgatttacttttcataattaaagatgtgaaagaaaaccgaaca
atatattttttagtaatgtttatgcgagacatataaaataa >Gene11:4209..4631, 423 bp atgtcgatgaaatatctgatgttgttgttcgctgctatgataatcagatcattcgccgatagtggtaacgctatcgaaacgacatcgccagaaattacaa
acgctacaacagatattccagctatcagattatgcggtccagagggagatggatattgtttacacggtgactgtatccacgctagagatattgacggta
tgtattgtagatgctctcatggttatacaggcattagatgtcagcatgtagtattagtagactatcaacgttcagaaaacccaaacactacaacgtcata
tatcccatctcccggtattatgcttgtattagtaggcattattattattacgtgttgtctattatctgtttataggttcactcgacgaactaaactacctatac
aagatatggttgtgccataa >Gene12:4786..5781, 996 bp atggatatttacgacgataaaggtctacagactattaaactgtttaataatgaatttgattgtataaggaatgacatcagagaattatttaaacatgtaa
ctgattccgatagtatacaacttccgatggaagacaattctgatattatagaaaatatcagaaaaatactatatagacgattaaaaaatgtagaatgt
gttgacatcgatagtacaataacttttatgaaatacgatccaaatgatgataataagcgtacgtgttctaattgggtacccttaactaataactatatgg
aatattgtctagtaatatatttggaaacaccgatatgtggaggcaaaataaaattataccaccctacaggaaatataaagtcggataaggatattatg
tttgcaaagactctagacttaaatcaaagaaagtgttaactggacgtaaaacaattgccgttctagacatatccgtttcatataatagatcaatgacta
ctattcactacaacgacgacgttgatatagatatacatactgataaaaatggaaaagagttatgttattgttatataacaatagatgatcattacttggt
tgatgtggaaactataggagttatagtcaatagatctggaaaatgtctgttagtaaataaccatctaggtataggtatcgttaaagataaacgtataag
cgatagttttggagatgtatgtatggatacaatatttgacttttctgaagcacgagagttattttcattaactaatgatgataacaggaatatagcatgg
gacactgataaactagacgatgatacagatatatggactcccgtcacagaagatgattacaaatttctttctagactagtattgtatgcaaaatctcaa
tcggatactgtattcgactattatgttcttactggtgatacggaaccacccactgtattcattttcaaggtaactagatttactttaatatgccgaaataa >Gene13:5315..5491, 177 bp atgtctagaacggcaattgtttttacgtccagttaacactttctttgatttaaagtctagagtctttgcaaacataatatccttatccgactttatatttcctgt
agggtggtataattttattttgcctccacatatcggtgtttccaaatatattactagacaatattccatatag

FIG. 13C

>Gene14:5576..5773, 198 bp atgtcaacacattctacatttttttaatcgtctatatagtatttttctgatattttctataatatcagaattgtcttccatcggaagttgtatactatcggaatc
agttacatgtttaaataattctctgatgtcattccttatacaatcaaattcattattaaacagtttaatagtctgtagacctttatcgtcgtaa >Gene15:6293..6847, 555 bp atggaattcgatcctgccaaaatcaatacatcatctatagatcatgtaacaatattacaatacatagatgaaccaaatgatataagactaacagtatg
cattatccgaaatattaataacattacatattatatcaatatcacaaaaataaatacacatttggctaatcaatttcgggcttggaaaaaacgtatcgcc
ggaagggactatatgactaacttatctagagatacaggaatacaacaatcaaaacttactgaaactatacgtaactgtcaaaaaaatagaaacatat
atggtctatatatacactacaatttagttattaatgtggttattgattggataaccgatgtgattgttcaatcaatattaagagggttggtaaattggtac
atagctaataatacctatactccaaatacacccaataatacaacaaccatttctgagttggatatcatcaaaatactggataaatacgaggacgtgtat
agagtaagtaaagaaaaagaatgtggaatttgctatgaagttgtttactcaaaacgatag >Gene16:6822..7010, 189 bp atgaagttgtttactcaaaacgatagatactttggtttattggattcgtgtactcatatattttgcataacatgcatcaatatatggcataaaacacgaag
agaaaccggtgcgtcggataattgtcctatatgtcgtacccgtttttagaaacataacaatgagcaagttctataagctagttaactaa >Gene17:7176..7556, 381 bp atgagaatcctatttctcatcgctttcatgtatgggtgtgttcacccatatgttaatgccgacgaaatcaaatgtcctaacctaaacatcgtaacatcttct
ggagaatttcgttgcactggatgtgtgaaatttatgcctaattttagctacatgtattggttggcaaaggatatgagatcggacgaggatgctaaattta
tagaacatttgggtgagggtatcaaggaggatgaaaccgttagtaccatagatggtagaatcgtcactctacagaaagtccttcatgtgactgatact
aataaatttgataattataggttcacttgtgtcctcactacgatagatggcgtttcaaaaaagaatatttggctgaagtag >Gene18:7347..7475, 129 bp atgttctataaatttagcatcctcgtccgatctcatatcctttgccaaccaatacatgtagctaaaattaggcataaatttcacacatccagtgcaacga
aattctccagaagatgttacgatgtttag >Gene19:7615..8328, 714 bp atgtcttatgcttgcccaattcttagtactataaacatttgcctaccttatcttaaagacattaacatgattgacaaacgaggagaaacacttcttcacaa
ggctgttagatataataaacaatctctagtatctttactgctagaatccggttcagatgtcaacattagatcaaataacggatatacatgtatagccatt
gccatcaacgaatctagaaacattgaactgctgaaaatgctattatgtcataaacctacattagattgtgtgattgattcattgagagaaatatctaac
atcgtagataactactatgctataaaacaatgtattaaatatgccatgattatagatgactgtacatcgtctaagattccagagtccataagtcaacgct
ataatgattatatagatctttgcaatcaagaattgaacgaaatgaaaaaaataatggtaggtggtaatactatgttctcattaatatttactgatcatgg
agctaaaattattcatagatatgccaataatccagaattacgtgagtattatgagttaaaacaaaataaaatatatgtggaagcatatgatattatttc
cgacgcaatagtgaaacatgatagaatacataaaaccatagaatcagttgatgataatacctacatttctaatcttccgtataccatcaaatacaaaat
attcgagcaacaataa >Gene20:8417..8830, 414 bp atgaaaggaatagataacactgcttattcatatatagacgatctaacatgttgcactcgagtaattatggctgattatctaaatagtgattatagataca
ataaagatgtagatttagatttggtcaaattgttttggaaaatggaaagccgcacggaataatgtgtagtattgtaccactatggagaaatgataagg
aaaccatctttttgatattgaaaacaatgaactcggatgtcctccaacatatactaattgagtatatgacattcggcgatatccctctagtggaatatgg
aactgtggtaaataaagaggctatacacgaatactttagaaatattaatattgattcttcacacgatgaaatatctactaaaaaaggaagggagatgcc
atcaattatctcgatga

FIG. 13D

>Gene21:8935..9093, 159 bp atggctgcagtgttctttatgaggacgagtactgatacgcgtatgatgattatcaactacgaaattgcggtaccgtattgcatctgtatatcatctctcat
ctgtattcaaagtcggatacgagagcatatgtgcgtccggaagttgttaaatgtctaa >Gene22:9097..9330, 234 bp atgttaaagttaaaggatatagcgatggctctactagaagccactggatttagcaacataaatgactttaatatattcagctatatgaaatccaaaaat
gtagacgttgacttgataaaggtgttggtagaacatggatttgacttgagtgttaaatgtgaaaaccatcgttcagttatagaaaattatgtaatgaca
atgatcctgttcctaaaattattgatttgttcatag >Gene23:9352..9567, 216 bp atgtttgactatctggaaaatgaggaggtggctctcgatgaacttaaacagatgttgagagacagagatcctaatgataccaggaaccaattcaaga
ataatgctttacacgcatacctttttaatgagcattgtaataatgtcgaggtcgtcaaactactactagacagtggcactaatccattacgcaaaaattg
gagacagctaccccattag >Gene24:10049..11953, 1905 bp atggttaacgataagatactctatgatagttgtaaaacatttaacatcgatgccagcagtgcacaatcattgatagaaagtggtgcaaatccattatat
gagtatgatggtgaaactccattaaaggcatacgttaccaagaaaaataataatatcaaaaacgatgttgtgattttgttattgtcgtcagtcgactat
aaaaatatcaatgattttgatatattcgaatatctatgttctgataacatcgatatagacttattgaaattactaatttcgaaaggtatagaaataaata
gtatcaaaaatggtattaatattgtagagaaatacgctacaacatcaaatcccaatgtagatgtgtttaaactattattggataaaggaatacctacat
gtagcaacatacagtatggatacaagatcaaaatagaacagattagacgtgctggtgaatattataattgggatgatgaattagacgattacgattac
gactacaccactgattatgatgatagaatgggtaaaacagttctctattattatattattactaggtcacaagatggttatgctacatctttggacgtgat
aaactatttaatttcacacaaaaaagagatgcgttattatacttatcgtgaacataccacactctattattatcttgacaaatgcgatattaaacgggaa
atatttgacgcgttattcgatagtaactatagtggtcatgaactaatgaatattctatctaactatttacgtaaacagtttaggaagaaaaatcacaaaa
tcgataattatatagttgatcaactattattcgaccgtgatacgttttatattttagaattgtgtaatagtttacgtaataatatcctaatatccacaattct
taaaagatatacagattctatacaagatctattgttagaatatgtatcttatcatacagtatacatcaatgttattaaatgtatgattgatgaaggagcta
cattatatagatttaagcatataaataaatattttcaaaaatttggcaatagagatcctaaagttgtcgagtatattttaaaaaatggaaacttagttgt
agataatgacaatgatgataacctaataaatattatgccattattccctaccttctctatgcgtgagttggatgtgttatcgatactaaaactttgtaagc
cgtatattgatgatataaacaaaatagataaacatggatgtagtatactttatcattgtattaagtcgcatagtgtcagcctagtagaatggttaataga
taatggcgcagacattaatataataacaaaatatgggtttacatgtattactatttgtgttatactggcagataaatatatcccagaaatagcagaatta
tatattaagatattggaaattattctgagtaaattaccaaccatcgaatgtattaagaaaacagttgattacctagacgatcacaggtacttattcatag
gtggtaataataaatcgttactgaaaatatgtatcaagtacttcatattagtcgattataagtacacatgtagcatgtatccatcatatatagaatttata
accgactgcgaaaaagaaattgcggatatgcgtcaaattaaaataaatggtacggacatgcttacagtgatgtacatgttaaataaacctacaaaga
aacgatatgttaataatccgatatttacagattgggctaataagcaatataagtttttataatcaaataatatataatgctaataagttaatagaacaaa
gtaagaaaatagacgacatgatagaggaggtatccattgacgataatcgtttatcaacactaccgttagaaattagacatttgattttctcgtacgcgtt
cctataa >Gene25:10509..10700, 192 bp atggttggtaatttactcagaataaatttccaatatcttaatatataattctgctatttctgggatatatttatctgccagtataacacaaatagtaatacat
gtaaacccatattttgttattatattaatgtctgcgccattatctattaaccattctactaggctgacactatgcgacttaatacaatga >Gene26:11547..11759, 213 bp

FIG. 13E atgttgctacatgtaggtattcctttatccaataatagtttaaacacatctacattgggatttgatgttgtagcgtatttctctacaatattaataccattttt
gatactatttatttctataccttttcgaaattagtaatttcaataagtctatatcgatgttatcagaacatagatattcgaatatatcaaaatcattgatattt
ttatag >Gene27:11996..12529, 534 bp atgtcttcgattagatttattgcatgtctatatctcatttccatcttcggaaattgtcatgaggatccatattatcaaccatttaataaattaaacattactc
tagatatatacacttatgaggatctagtaccatacaccgtagacaatgacacaacttctttcgttaagatatactttaaaaaattttggattactgttatg
actaaatggtgtgctccgtttattgataccgttagcgtatacacatcgcatgataatctgaatatagaattttatactagagacgaatatgatacacaaa
gcgaggataaaatttgtaccattgatgttaaagcacgatgcaaccatctaacaaaaccagaagttacagtacaaaaagaagcgtacagatattcatt
atcttctgacctatcgtgtttttgattctatagatctagacattgatctgatcgaaactaatagtactgacactacagtactgaaatcatatgagctcatgc
ttcccaaacgtgctaaatccatacataactga >Gene28:12006..12254, 249 bp atggatttagcacgtttgggaagcatgagctcatatgatttcagtactgtagtgtcagtactattagtttcgatcagatcaatgtctagatctatagaatc
aaaacacgataggtcagaagataatgaatatctgtacgcttcttttgtactgtaacttctggttttgttagatggttgcatcgtgctttaacatcaatggt
acaaattttatcctcgctttgtgtatcatattcgtctctagtataa >Gene29:12179..12403, 225 bp atggttgcatcgtgctttaacatcaatggtacaaattttatcctcgctttgtgtatcatattcgtctctagtataaaaattctatattcagattatcatgcgat
gtgtatacgctaacggtatcaataaacggagcacaccatttagtcataacagtaatccaaaattttttaaagtatatcttaacgaaagaagttgtgtca
ttgtctacggtgtatggtactag >Gene30:12601..13053, 453 bp atgggtatacagcacgaattcgacatcattattaatggagatatcgcgttgagaaatttacagttacataaaggggataactacggatgcaaactaaa
aattatttcgaatgattacaagaaattaaagtttagattcattatacgcccagattggtcggaaatcgacgaggtcaaaggattaaccgtatttgcaaa
caactatgcggtgaaagttaataaggtagatgacacgttctattacgtaatatatgaggctgtaatacatctgtataacaaaaaaacagagatattga
tttattctgatgatgagaacgaactctttaaacactattacccatacatcagtctaaatatgattagtaaaaagtataaagttaaagaagaaaactact
catccccgtatatagaacatccgttaatcccgtatagagattatgagtccatggattaa >Gene31:13286..13741, 456 bp atgaatgcgtataataaagccgattcgttttctttagagtctgattctatcaaagatgttatacacgattatatttgttggctcagtatgactgatgaaatg
agaccatctatcggaaacgtctttaaagcgatggaaacgtttaagatagacgcggttagatattacgatggtaacatatatgaattagctaaagatat
aaatgcgatgtcgtttgacggtttttataagatctctacaaactatcgcttcaaagaaagataaactcactgtttatggaaccatgggactgctgtctatt
gtcgtagatattaacaaaggttgtgatatatccaatatcaagttcgctgccggaataatcattttaatggagtatattttgatgacacggatatgtctca
tcttaaagtagcactctatcgtagaatacagagacgtgatgatgtagatagataa >Gene32:13868..14482, 615 bp atggcgtatatgaacagatcagatctcgataaactaaaacacgaaaatatctttctgggaatattatagaggacgccaaagagttcgtctttggatct
agaaaaatatatactgattctgttgatgatctaatagaattatatagtttagcaaatatcttaacaacgaaaatcttaaagatgtagtgattgagaga
atggattatgtgtgcaaatatatcggtaaagataattggagtactatatattcgtttttataaagaaaatggtctacgtaatagttttctacgacaatacat
caacaataatatagaagagatatgtaacacagaccaatttctaaaattggatgtagattcagtatgtgatattctagacaacgatgagatcgtagtaa
ctagagaatatactatcttaaacatggtattacgatggctagaaaataaaagagttaatatagacgactttactaaagtcatgttcgttattcgatttaa
atttataacatattctgaacttactaatgcgataaagaaaatagctccagaatacagacaatgcttacaggatctataccatatgaaaattacgcgtcc
tagacactttgataactag

FIG. 13F

>Gene33:14545..15495, 951 bp atggatactattaaaatatttaatcatggagagtttgatactattagaaatgaattggtcaacttgttaaaagttgtaaaatggaacaccattaattcaa
atgtaacggtatcgtctaccgacacaatagatatatctgattgtatcagagagagatattatacaaacagtttaaaaatgtacgaaatatagaggtgagc
agtgatatatctttcataaaatataatagatttaatgatactactctaacagatgataatgtgggatattatttagtgatttatttgaatcggacgaaatc
tgtaaagactttaatatatcctactccagaaacagtgataacatcatccgaggatataatgttttctaaatctcttaactttagattcgagaatgtaaag
cgcgactataaattggttatgtgttctatatctttgacatacaagccatctatatgcagaatccaatacgataacaataaatatttagatattagcgaca
gtcaagaatgtaataatctatgttactgcgtcataactatggatccccaccacttgatagatttagaaaccatatgtgtcttggtcgataaatcaggaaa
gtgtttgctagtaaacgagttttatattagatttaggaaaaatcacatctacaatagctttgccgatctatgcatggatcatatatttgaactaccgaata
caaaagaattattcactctgcgcaacgatgatggacgaaacatagcctgggataatgataagttggaaagtggtaataatacatggattcctaaaac
agatgatgagtataagtttctatctaaattgatgaatattgcgaagtttaacaacaccaaatttgattactacgtgcttgttggagatacggatccgtgt
actgtctttacgttcaaagtaacaaagtattacatcaatctcaattatgaatag >Gene34:15281..15472, 192 bp atgaaagatatatcactgctcacctctatatttcgtacatttttaaactgtttgtataatatctctctgatacaatcagatatatctattgtgtcggtagacg
ataccgttacatttgaattaatggtgttccattttacaacttttaacaagttgaccaattcatttctaatagtatcaaactctccatga >Gene35:15562..16347, 786 bp atgaaggtggagagcgtgacgttcctgacattgttgggaataggatgcgttctatcatactgtcctattccttcacgtcccattaatataaaatttaaga
atagtgtggaaactaatgctaattacaacataggagacactatagaatatctatgtctacctggatacagaaagcaaaaaatgggacctatatatgct
aaatgtacaggtactggatggacactctttaatcaatgtattaaacggagatgcccatcgcctcgagatatcgataatggccaacttgatattggcgga
gtagactttggctctagtataacgtactcttgtaatagcggatatcagttgatcggtgaatctaaatcgtattgtgaattaggatctactggatctatggt
atggaatcccgaggcacctatttgtgaatctgttaaatgccaatccctccatctatatccaacggaagacataacggatacgaggattttataccgat
gggagcgttgtaacttatagttgcaatagtggatattcgttgattggtaactctggtgtcctgtgttcaggaggagaatggtccgatccacccacgtgtc
agattgttaaatgtccacatcctacaatatcaaacggatacttgtctagcgggtttaaaagatcatactcatacaacgacaatgtagactttaagtgca
agtacggatataaactatctggttcctcatcatctacttgctctccaggaaatacatggaagccggaacttccaaaatgtgtacgctaa >Gene36:16262..16405, 144 bp atgggcttttttattatttgtacgatgtccaggataacattttttacggataaataaatatgaaggtggagagcgtgacgttcctgacattgttgggaatag
gatgcgttctatcatactgtcctattccttcacgtcccattaa >Gene37:16290..16469, 180 bp atgatagaacgcatcctattcccaacaatgtcaggaacgtcacgctctccaccttcatatttatttatccgtaaaaatgttatcctggacatcgtacaaat
aataaaaaagcccatatatgtttgctattgtagaaattgttttttcacagttgctcaaaaacgatggcagtgacttatga >Gene38:16415..17935, 1521 bp atggaaagcgtgatattttctatcaatggggaaattatacaagtgaataaggaaattattacggcgtctccgtataattttttttaaacgcattcaggagc
accatatataatgatgaagtgattatattgaatggtataaactatcacgcgtttgaatcgctattagactatatgcgctggaagaagataaacatcacca
taaacaatgtagaaatgatactagttgctgccgtaataattgatgttacgcctgtagtagatctatgtgtaaaaactatgattcataatattaattccac
aaaattgtataaggatgtttaacttttctaaacaatatggaattaaaaaactatataatgcgtcgatgttagaaataatcaacaatattactgcggtgac
atccgatccagaatttggaaaattatcaaaggatgaactgacaactatcttatcccacgaagacgttaacgtaaatcatgaggatgttacagctatgat
attattaaagtggatacataaaaatccaaacgatgtagatatcatcaacatttcatcccaagtttatgactaatactatgcgcaatgctatatcattg
ttgggattaactatatccaaatctacaaagccagtgacacgaaatggtataaaacataatatagtagtcattaaaaaactctgattatatatccacaata
acccattactctcctagaacagaatattggacgatagtcggtaatacagatagacaattctataatgcaaatgttttacataattgtctatacattattg

FIG. 13G gcggcatgattaacaatagacatgtttattccgtatcgcgggtagatcttaaaacgaaaaaatggaaaacggttactaatatgtcgtcgttaaaatcag
aagttagtacttgtgttaacgatggaaagttatatgtaataggaggattagaattttctatttcaacgggtgtggcagaatatttgaaacacggcacttc
gaaatggataagacttccaaacttaattactcctagatattcaggcgcgtcggtattcgtaaacgatgatatatatgtaatgggtggagtttataccacg
tatgagaaatatgtagtattaaacgatgtagaatgtttcactaaaaatcgttggataaaaaagtctcccatgcctagacatcatagtatagtttatgctg
tagagtacgatggtgacatctatgcaattactggaattacttatgagactcgtaattatctatacaaatatatagttaaggaagacaaatggatagaat
tatacatgtactttaaccatgtaggaaagatgttcgtgtgttcttgcggtgattatatcttaattatagcagatgcaaaatacgaatattatccaaaatca
aatacttggaatttgttcgatatgtcaactcgtaatatcgaatattatgatatgtttactaaagatgaaactcataagtcactgccatcgttttttgagcaa
ctgtgaaaaacaatttctacaatag >Gene39:17268..17462, 195 bp atgactactatattatgttttataccatttcgtgtcactggctttgtagatttggatatagttaatcccaacaatgatatagcattgcgcatagtattagtca
taaacttgggatgtaaaatgttgatgatatctacatcgtttggattttatgtatccactttaataatatcatagctgtaacatcctcatga >Gene40:18002..18676, 675 bp atggtgaaaaataataaaataagtaatagctgccgaatgataatgagtactaaccctaataatattttaatgagacatctcaaaaatcttacagatga
tgaatttaaatgtattattcatcgatcatctgattttctttatttgtctgatcgtgactatactagtataaccaaagaaacattagttagtgagatcgtaga
agaatatccggatgattgtaataaaatattagctattatattttggtgttagataaagacatagatgtagatataaaaactaaactaaagcctaaacc
cgcagttagatttgccattctagacaagatgactgaggatattaaactaacggatcagtcagacattatttagatacatagaacaagatataccact
aggtccgttgttcaaaaaaatagattcgtacagaacaagagccattaataagtattcgaaagagttaggattggctactgaatactttaataagtacg
ggcatttaatgtttatactctccctataccatataatagattctttgtagaaattcgataggcttttagcggttctatcgcctacgataggacacgtaa
aagcattttataaattcatagaatacgtttctatagatgatagacggaaatttaaaaaggaattaatgtcaaaatga >Gene41:18663..19016, 354 bp atgaggactctacttattagatatattctttggagaaatgacaacgatcaaacctattataatgatgattttaaaaagcttatgttgttggatgaattggt
agatgacggcgatgtatgtacattgattaagaacatgagaatgacgctgtccgacggtccattgctagatagattgaatcaaccagttaataatatag
aagacgctaagcgaatgatcgctattagtgccaaagtggctagagacattggtgaacgttcagaaattagatgggaagagtcattcaccatactcttt
aggatgattgaaacatattttgatgatctaatgattgatctatatggtgaaaaataa >Gene42:19136..19663, 528 bp atgacgtcctctgcaatggataataatgaacctaaagtactagaaatggtatatgatgctacaattttacccgaaggtagtagcatggatccaaatatc
atggattgtataaacagacacatcaatatgtgtatacaacgcacctatagttctagtataattgccattttggatagattcctaatgatgaacaaggatg
aactaaataatacacagtgtcatataattaaagaatttatgacatacgaacaaatggcgattgaccattatggaggatatgtgaacgctattctatatc
aaattcgtaaaagacctaatcaacatcacaccattgatctgtttaaaagaataaaaagaacccggtatgacacttttaaagtggatcccgtagaattc
gtaaaaaaagttatcggatttgtatctatcttgaacaaatataaaccggtttatagttacgtcctgtacgagaacgtcctgtacgatgagttcaaatgttt
cattgactacgtggaaactaagtatttctaa >Gene43:19705..21123, 1419 bp atgatatttgttatagagagtaaattgttgcaaatatacagaaatagaaatagaaatattaatttttatactacaatggacaacattatgtcggccgagt
attatctatctctttatgccaaatataatagtaaaaatttagatgtatttaggaatatgctacaagctatcgaaccttctggaaataattatcacattctac
atgcgtattgtggaattaaaggactagatgaacgatttgtcgaagaacttcttcatagaggatactctccaaatgagacggatgatgatggaaattatc
cattgcatatagcttctaaaattaataataatagaatagtcgcgatgctgctgacgcacggcgcagatccaaacgcgtgtgataaacataataaaaca
cctctatattatctctcgggaacagatgatgaagtcatagagagaataaatttattggtacagtatggagccaagattaacaactcggttgatgaaga
aggatgtggtccgttgttggcgtgtacagatccttcagaaagagtgtttaaaaaaataatgtccatcggattcgaagccaggatagtggataaatttgg
caaaaatcatattcatagacatcttatgtcagacaatccaaaagcttctacaatctcatggatgatgaaactaggaattagtccctcaaaaccagatca

FIG. 13H tgatggaaatacacctctccatattgtatgctctaaaacagtcaagaatgtagacattatagatctttacttccatcaacggatgttaataaacaaaac
aaattcggagatagtcctcttacacttcttattaagacattgagcccagcgcatcttattaacaaattgctatcgactagcaatgttattacggatcaaa
cagttaatatttgtatcttttatgatagagatgatgtttagaaattattaatgataaaggaaagcaatatgatttaccgattttaagatggctgttgaa
gtgggatccataagatgcgtcaaatatctattagacaatgatataatttgtgaagatgccatgtactacgctgtactatctgaatacgaaacaatggta
gactatcattgttcaatcatttagtgtagactctgtagttaacggtcatacatgtatgagcgaatgtgtaagactaaataacccagtcattttatcgaa
gctgatgttacataatcctacttctgagaccatgtatctaactatgaaagctatagaaaaagatagactagataaatctattattattccgtttatcgcgt
actttgtacttatgcatccggacttttgtaaaaatcgtagatactttacttcatataaacgttttgtaactgattatgttcatgaaggagtatcttacgaag
tattcgatgattatttttaa >Gene44:20561..20716, 156 bp atggacattatttttttaaacactctttctgaaggatctgtacacgccaacaacggaccacatccttcttcatcaaccgagttgttaatcttggctccatac
tgtaccaataaatttattctctctatgacttcatcatctgttcccgagagataa >Gene45:21101..21763, 663 bp atggtttacaaattagtcttactcttttgtatcgcatctctcgggtattcagtagaatacaagaatactatatgtcctcctcgacaagattaccggtattgg
tactttgccgccgaactcactattggtgtaaattacgacattaattctactattattggtgagtgtcatatgagtgaaagctatatcgacagaaatgctaa
catagtgttgactggatacggactagaaataaacatgaccatcatggatacggatcagagatttgtggcagcggctgagggtgttggtaaagataata
aactatctgttctgttgtttaccactcagcggctagataaagttcatcataatattagtgtgacaataacatgtatggaaatgaattgtggaaccacaaa
atacgatagcgatcttccggaatcaattcatataatcatcatcgtgtgatataactataaatggatcatgtgtgacatgtgttaacttagagactgatcca
acaaagattaatccccattacctacaccccaaggataaatatctttatcataattctgagtatggcatgcgtggtagttatggcgtgacatttatagatg
aactaaaccagtgccttcttgacataaaagaactaagttatgatatttgttatagagagtaa >Gene46:21898..22752, 855 bp atggatctgtcacgaattaatacttggaagtctaagcagctgaaaagctttctctctagcaaagatgcatttaaggcggatgtccatggacatagtgcc
ttgtattatgcaatagctgataataacgtgcgtctagtatgtacgttgttgaacgctggagcattgaaaaatcttctagagaatgaatttccattacatca
ggcagccacattggaagataccaaaatagtaaagattttgctattcagtggactggatgattcacaatttgatgacaagggaaacaccgcattgtatt
atgcggttgatagtggtaacatgcaaacggtaaaactgtttgttaagaaaaattggagactgatgttctatgggaaaactggatggaaacttcatttt
atcatgccgtcatgcttaatgatgtaagtattgtttcctactttctttcagagataccatctacttttgatctggctattctccttagttgtattcacaccact
ataaaaaatggacacgtggatatgatgattctcttgctcgactatgacgtcgacaaacaccaataattccttctcttcattccggacattaaattgg
ctatagataataaagacattgagatgttacaggctctgttcaaatacgacattaatatctcattctgctaatctggaaaatgtactattggatgatgccga
aatagctaaaatgattatagaaaagcatgttgaatacaagtctgactcctatacaaaagatctcgatatagtcaagaataataaattggatgaaataa
ttagcaaaaacaaggaactcagactcatgtacgtcaattgtgtaaagaaaaactaa >Gene47:22974..24083, 1110 bp atgattgcgttattgatactatcgttaacgtgttcagtgtctacctatcgtctgcaaggatttaccaatgccggtatagtagcgtataaaaatattcaaga
tgataatattgtcttctcaccgtttggttattcgttttctatgtttatgtcgctattgcctgcatcaggtaatactagaatagaattattgaagactatggatt
tgagaaaaagagatctgggtccagcatttacagaattaatatcaggattagctaagctgaaaacatctaaatatacgtacactgatctaacttatcaa
agtttcgtagataatactgtgtgcattaaaccgtcgtattatcaacaatatcatagattcggcctatatagattaaactttagacgagatgcggttaata
aaattaattctatagtagaacgtagatccggtatgtctaatgtagtagattctaatatgctcgacaataatactcatgggcaatcattaatactatatat
tttaaaggtatatggcaatatccgtttgatatcactaaaacacgcaatgctagttttactaataagtacggtacgaaaacggttcccatgatgaacgta
gttactaaattgcaaggaaatacaatcacaatcgatgacgaagaatatgatatggtacgccttccgtataaggatgctaatattagtatgtacctggca
ataggtgataatatgacccatttcacagattctattacggctgcaaaattagactattggtcgtttcaattagggaataaagtgtacaatcttaaactcc
ctaaattttctatcgaaaataagagggatattaagtcgatagccgaaatgatggctcctagtatgtttaatccagataatgcgttgtttaaacatatgac
tagggacccattatatatttataaaaatgtttcagaatgcaaagatagatgtcgacgaacaaggaactgtagcagaggcatctactatcatggtagcta

FIG. 13I cggcgagatcatctcctgaaaaactggaatttaatacaccatttgtgttcatcatcagacatgatattactggatttatattgtttatgggtaaggtggaa
tctccttaa >Gene48:23361..23606, 246 bp atgggtcatattatcacctattgccaggtacatactaatattagcatccttatacggaaggcgtaccatatcatattcttcgtcatcgattgtgattgtatt
tccttgcaatttagtaactacgttcatcatgggaaccgttttcgtaccgtacttattagtaaaactagcattgcgtgttttagtgatatcaaacggatattg
ccatatacctttaaaatatatagtattaatgattgcccatag >Gene49:23491..23730, 240 bp atgggaaccgttttcgtaccgtacttattagtaaaactagcattgcgtgttttagtgatatcaaacggatattgccatatacctttaaaatatatagtatta
atgattgcccatagagtattattgtcgagcatattagaatctactacattagacataccggatctacgttctactatagaattaattttattaaccgcatct
cgtctaaagtttaatctatataggccgaatctatga >Gene50:24133..24399, 267 bp atgcttgcattttgttattcgttgcccaatgcgggtgatgtaataaagggcagagtatacgagaatgattatgctctatatatttatcttttgactatcctc
actttgaagctatcttggcagagagtgttaagatgcatatggatagatatgttgaatatagggataaactggtagggaaaactgtaaaagttaaagtg
attagagttgattatacaaaaggatatatagatgtcaattacaaaaggatgtgtagacatcaataa >Gene51:24139..24324, 186 bp atgtctacacatcctttgtaattgacatctatatatcctttgtataatcaactctaatcactttaacttttacagttttccctaccagtttatccctatattc
aacatatctatccatatgcatcttaacactctctgccaagatagcttcaaagtgaggatagtcaaaaagataaatatatag >Gene52:24451..25725, 1275 bp atgaatccggataatacaatcgcagtgattacagagactattcctataggtatgcaatttgataaagtatatttgtctacatttaacatgtggagggaaa
ttctatccaataccacaaaaacactagatatatcatcttttttattggagtttatcggatgaagtgggtacgaatttcggcacgataatattaaacgagat
tgtacaattacccaaaagaggagtaagagttagagtagccgtcaataaatctaacaaaccattaaaggatgttgaaagactacaaatggccggagtt
gaagtacgatacatagatattacaaatatcctaggaggagttcttcatacaaaatttggatatctgataatacacatatttatttaggaagcgctaaca
tggattggagatcactaactcaggtcaaagaattgggtattgcgatcttcaataataggaacttggcagcggatctcactcaaattttttgaggtatactg
gtatcttggagttaacaatctaccatataattggaaaaacttttatccgtcgtattataatacagatcatcctcttagtattaacgtaagtggtgttccaca
ctctgtatttattgcttctgcaccgcaacaactatgtactatggaaagaaccaatgatttaaccgctttattgtcatgtattagaaatgcgagtaaattcg
tttatgtatctgttatgaactttatccctattatttattcgaaggcaggcaatattttgttttggccttatatagaagatgaattaagaagagccgctatag
acagacaagtatccgttaagctattgattagttgctggcaacgatcttcgtttatcatgagaaactttttaagatctatcgctatgctaaaatctaaaaac
ataaatatagaagtaaagctatttattgtaccagatgctgatcctcccattccgtattctagggtaaaccatgccaaatatatggtaaccgataaaacg
gcgtatataggtacctcaaattggacaggaaattactttacggatacatgtggagcatctattaatattacaccggatgatggattaggtcttcgtcaac
aattggaagatatttttatgcgtgattggaattcaaaatacagctatgaattgtacgatactagtcctactaaaaggtgtagactattaaaaaatatga
aacaatgtacaaatgatatatactgcgatgagatacaaccggaaaaagaaattcctgaatattctcttgaataa >Gene53:24773..24958, 186 bp atgggaggatcagcatctggtacaataaatagctttacttctatatttatgtttttagattttagcatagcgatagatcttaaaaagtttctcatgataaac
gaagatcgttgccagcaactaatcaatagcttaacggatacttgtctgtctatagcggctcttcttaattcatcttctatataa >Gene54:25415..25585, 171 bp

FIG. 13J atgtatcgtacttcaactccggccatttgtagtctttcaacatcctttaatggtttgttagatttattgacggctactctaactcttactcctcttttgggtaat
tgtacaatctcgtttaatattatcgtgccgaaattcgtacccacttcatccgataaactccaataa >Gene55:25901..26266, 366 bp atgggagcaacaatttctatactagcctcttacgataatccaaacttgtttacagcaatgattctaatgtctcctctagttaatgcagatgctgtttcaaa
actgaatctgctagctgccaaacttatgggaaccatcacaccaaatgcgccagtcggaaagctatgtccagaatcagtatctagagatatggataaag
tttataaataccaatacgacccattaatcaatcatgaaaaaattaaggctggatttgctagtcaggtcttgaaggctaccaacaaggttagaaaaata
attcccaagattaacacccccgactctcatactccagggaacaaacaatgagattagcgatgttttag >Gene56:26242..26574, 333 bp atgagtgcaaactgtatgttcaatctggacaatgattacatatattggaaacctattacatatcctaaggcattagtattcataagtcatggagctggta
aacattctggacgttatgacgaactagctgaaaacatatcatcgttaggaattttagtattctcacatgatcatattggacatggaagaagtaatggtg
aaaaaatgatgattgatgactttggtacgtatgttagagatgtggtacagcacgtggtaactattaaatctacttatttaggagttccagtcttcttattg
ggcattccatgggagcaacaatttctatactag >Gene57:26713..27162, 450 bp atggcgactaaattagattatgaggatgctgttttttactttgtggatgatgataaaatatgtagtcgcgactccatcatcgatctaatagatgaatatat
tacgtggagaaatcatgttatagtgtttaacaaagatattaccagttgtggaagactgtacaaggaattgatgaagttcgatgatgtcgctatacggta
ctatggtattgataaaattaatgagattgtcgaagctatgagcgaaggagaccactacatcaattttacaaaagtccatgatcaggaaagtctattcgc
taccataggaatatgtgctaaaatcactgaacattggggatacaaaaagatttcagaatctagattccaatcattgggaaacattacagatctgatga
ccgacgataatataaacatcttgatactttttctagaaaaaaaattgaattga >Gene58:26797..26991, 195 bp atggacttttgtaaaattgatgtagtggtctccttcgctcatagcttcgacaatctcattaattttatcaataccatagtaccgtatagcgacatcatcgaa
cttcatcaattccttgtacagtcttccacaactggtaatatctttgttaaacactataacatgatttctccacgtaatatattcatctattag >Gene59:27227..27907, 681 bp atgttgtcgatgtttatgtgtaataatatcgtagattatgtagatgatatagataatggtatagtacatgatatagaagatgaggctagcaataatgttg
atcacgactatgtatatccacttccagaaaatatggtatatagatttgacaagtccactaacatactcgattatctatcaacggaacgggaccatgtaa
tgatggctgttcgatactatatgagtaaacaacgtttagacgacttgtatagacagttgcccacaaagactagatcatatatagatattatcaacatata
ttgtgataaagttagtaatgattataataggacatgaatatcatgtatgatatggcatctacaaaatcatttacagtttatgacataaataacgaagtt
aatactatactaatggataacaaggggttgggtgtaagattggcgacaatttcatttataaccaaattgggtagacgatgtatgaatccagtaaaaact
ataaaaatgtttactctactatcgcatactatatgcgatgattgtttgtagattatataacggacatttcaccaccagataataccatccctaacactag
cacgcgtgaatatctaaagcttattggcatcacagctatcatgtttgctacatataaaactctcaaatacatgataggataa >Gene60:27919..28362, 444 bp atgttcaacatgaatattaactcaccagttagatttgttaaggaaactaacagagctaaatctcctactaggcaatcgccgggtgctgccggatatgat
ttgtatagcgcttacgattatactatccctccaggagaaagacagttaattaagacagatattagtatgtccatgcctaagatttgctatggtagaatag
ctcctaggtctggtctgtcactaaaaggcattgatataggaggtggtgtaatagacgaagattataggggaaacataggagtcattcttattaataatg
gaaaatgtacgtttaatgtaaaatactggagatagaatagctcagctaatctatcaacgtatatattatccagaactggaagaagtacaatctctagata
gtacaaatagaggagatcaagggtttggatcaacaggacttagataa >Gene61:28386..29828, 1443 bp

FIG. 13K atgccgatatttgttaatactgtgtactgtaagaatatattagcattgtctatgactaagaaattcaaaacaattattgatgctataggtggcaatataat
agtcaattctacgatattgaaaaagttatctccttactttcgcacacatttacgtcaaaaatacacgaaaaataaagatccagttacgagggtttgtcta
gaccttgacattcacagtttaacttctatagttatttactcgtatactggaaaggtatatatagatagtcataacgtcgtcaatttattacgtgcttctatat
taacctctgtagaatttatcatctacacttgtataaactttatcttacgagattttagaaaggaatattgtgtcgagtgttacatgatgggtatagaatac
ggactatccaatctcttatgtcatactaaaaactttattgccaaacacttttggaactggaagatgacatcatagacaattttgattatctatctatgaa
acttattctagaaagcgatgaactaaatgttccagatgaggattatgtagttgattttgtcattaagtggtatataaagcgaagaaataaattaggaaa
tctgctactccttatcaaaaatgtaatcaggtcaaattatctttctcccagaggtataaataatgtaaaatggatactagactgtaccaaaatatttcatt
gtgataaacaaccacgcaaatcatacaagtatccattcatagagtatcctatgaacatggatcaaattatagatatattccatatgtgtacaagtactc
atgttggagaagtagtatatctcatcggtggatggatgaacaatgaaatacataacaatgctatagctgtaaattatatatcaaacaattggattccaa
ttcctccgatgaatagccccagactgtatgctagcgggatacccgctaacaataaattatacgtagtaggaggtctaccaaatcccacatctgttgagc
gttggttccacggggatgctgcttgggttaatatgccgagtcttctgaaacctagatgtaatccagcagtggcatctatataaacaatgttatatacgtaat
gggaggacattctgaaactgatacaactacagaatatttgctacccaatcatgatcagtggcagtttggaccatccacttattatcctcattataaatca
tgcgcgttagtgttcggtagaaggttattcttggttggtagaaatgcggaatttattgtgaatccagcaatacatggactctgatagatgatcctattta
tccgagggataatccagaattgatcatagtggataataaactgctattgataggaggatttttatcgtgaatcgtatatagatactatagaagtgtacaa
tcatcacacttattcatggaatatatgggatggtaaataa >Gene62:29839..30798, 960 bp atggaacccatccttgcaccaaatccaaatagatttgttattttcccaatccaatattatgacatctggaacatgtataaaaaggcagaggcatcatttt
ggacagtggaagaagtagatatatctaaagatatcaatgattggaataaactaacaccagacgaaaaatattttataaaacatgtattggcgttttttg
cagccagtgacggaatagtgaatgaaaatttggcggaacgattttgtacagaagtacagattaccgaggctagatgtttctacggatttcagatggcc
attgaaaacattcattcggaaatgtatagtcttttgatcgatacttatgttaaagatagtaatgaaaaaaaactatctctttaatgccatagaaacgatgc
cttgtgtaaaaaagaaggccgattgggctcaaaagtggatacatgacagcgccggttatggagagagacttattgcctttgctgcagtagaaggaatc
ttcttttccggatcattcgcttccatattttggcttaaaaagcgtggcctaatgcccggactcacgtttccaacgaactaattagtagagacgagggtct
acactgcgacttcgcatgtttgatgtttaaacatttattgtatccaccgagtgaagaaaccgttagatctattataacagatgcagtatccattgaacaa
gaatttcttactgcggctcttccagttaaacttataggaatgaattgtgaaatgatgaaaacatatatagaattcgtcgcggatagattgatttctgaatt
gggatttaaaaaaatttataatgttaccaatccgtttgatttcatggaaaatatatcattggaaggaaaaactaattttttcgaaaaacgtgtgggtgaa
taccaaaaaatgggagttatgtctcaaaaagataatcattttctctagatgttgacttttaa >Gene63:30110..30346, 237 bp atggatactgcatctgttataatagatctaacggtttcttcactcggtggatacaataaatgtttaaacatcaaacatgcgaagtcgcagtgtagaccct
cgtctctactaattagttcgttggaaaacgtgagtccgggcattaggccacgctttttaagccaaaatatggaagcgaatgatccggaaaagaagatt
ccttctactgcagcaaaggcaataagtctctctccataa >Gene64:30358..30648, 291 bp atgtatccacttttgagcccaatcggccttcttttttacacaaggcatcgtttctatggcattaaagagatagtttttttcattactatctttaacataagtat
cgatcaaaagactatacatttccgaatgaatgttttcaatggccatctgaaatccgtagaaacatctagcctcggtaatctgtacttctgtacaaaatcg
ttccgccaaattttcattcactattccgtcactggctgcaaaaaacgccaatacatgttttataaaatattttcgtctggtgttag >Gene65:30830..31795, 966 bp atgggtacgaacggcgttagagtatttgtcattttatatttgttggctgtatgcggatgtatcgaatacgacgtagacgataatgtacatatttgtaccca
cactaacgtgtcacatattaatcacactagttggtattataatgataaggttatagcgctagccaccgaggataaaacttctggttatatatcatcattc
ataaaacgcgttaatatctcattaacttgtttaaatatatcgagtttgaggtacgaagattctggtacatacaaaggagtatcgcatctaaaagatgga
gtcatcgttacgactactatgaatatatctgtaaaggctaatatcattgacttgactggtagagtgcgttatctaaccagaaattattgcgaagttaaaa
tacgatgcgaaataacatctttcgcgcttaatggttctactacaccaccacatatgatattaggaacagtagataaatggaaatatcttccatttcctac

FIG. 13L agatgattatagatacgtaggggaactgaaaagatatatatctggaaacccatatccaacagagtcgctagcgttagaaattagctcgacgtttaatc
ggtttactatcgttaaaaatttgaacgataacgagttttcttgttatctgttttcacaaaattatagtttccataaaatgttgaatgtgcgtaacatttgtga
atccaaatggaaggcgttaaataataatgataatgcatcctccatgcccgcttcccacaacaatctcgcaaacgatttatttagtatgatgtcacaatta
caaaatgataatgatgataataacgattattcagcacccatgaatgtcgataatttaattatgatagtactaataacaatgctatcaataatacttgtaa
ttattgtagtgattgcggcgatatcgatgtacaaaaaatccaagtacaggcatatagataactga >Gene66:31449..31610, 162 bp atgatattagcctttacagatatattcatagtagtcgtaacgatgactccatcttttagatgcgatactcctttgtatgtaccagaatcttcgtacctcaaa
ctcgatatatttaaacaagttaatgagatattaacgcgttttatgaatgatgatatataa >Gene67:31825..32049, 225 bp atgagtaaaatactcacgtttgttaaaaataagataattgacttgattaataatgaccaaattaaatattctagagttataatgatagaagagtccgat
agtcttttaccggttgatgaggtgcatgctaaccacggatttgactgtgtggagatgatagatgaaaatataagcaatgagaatatcgaacagtataa
aaccgaatctttttttacaataaaattga >Gene68:32065..32307, 243 bp atgacgctcgtcatgggatcctgctgtggtagattctgtgacgctaagaataagaataagaaggaagatgtagaagagggaagagaaggatgttac
aattataagaaccttaatgatctcggatgaatccgaagcacgtgtagaatttggaccattatatatgataaatgaagaaaaatcagacataaatacatt
ggatataaaaagaagatatagacacacgatagagtctgtatatttctaa >Gene69:32459..32656, 198 bp atgggagggatctaaacgcaaacacgacagtcggcgactacaacaagaacaggagcagcctcgtccacgtacaccgccatcatatgaagaaattgca
aaatatggacactcatttaacgtgaaaagatttacgaataaagaaatgtgtcttaaaaatgattatccacgaattatatcatataatcctccaccaaaa
tag >Gene70:32716..33354, 639 bp atggcggaaactaaagagtttaaaactttgtataatcttttttatagatagttatttacaaaaattagctcaacattctatccctactaatgtcacttgtgct
attcatataggagaggttataggacagtttaaaaattgcgcgctccgaataactaacaaatgcatgagtaattctcgacttagtttcacactcatggttg
aatcatttattgaagtgatttcattgcttccggaaaaaggatagaagagctatcgctgaagaaataggaatagatctagacgatgtacctagtgcggtat
ccaagctagaaaagaactgtaatgcgtatgcggaggttaataatattatagatatacagaaattagatatcggagaatgttcggctccgcccggtcaa
catatgcttttacagatagttaatacaggatccgcgggaagcaaattgtggtttacagacaattgttaagtccttaaataaaatatacgttccacctattat
cgaaaaccgattgccgtattacgatccgtggtttctagtgggtgtagcaattattctagttattttttactgtagctatttgttctattagacgaaatctggct
cttaaatacagatacggaacgtttttatacgtttaa >Gene71:33341..34660, 1320 bp atgggtgttgccaatgattcatcccctgaatatcaatggatgtctccccatagattatcagatactgttatattaggagactgtttgtattttaacaatata
atgtcccaattagatttacaccaaaattgggctccgtcagttagattgttaaattattttaagaattttaataggggaaacactactaaagatagaagag
aatgattacattaattcatcctttttccaacaaaaggataaacgattttatcctataaacgacgattttttatcacatatctacaggaggatatggtatagt
ctttaagatagataactatgtagtaaaatttgtattcgaggccacaaaattatatagtcccatggaaactacggcggagttcacagtacccaaatttct
atacaacaatctaaagggagatgaaaaaaaattaatcgtgtgtgcgtgggccatgggattaaactataaattaacatttttacatactctgtataaacg
ggttcttcatatgttgctattattgatacaaactatggatggtcaggaactctcattgagatattcttcaaagtttttttaaaggcgtttaacgagagaaa
ggacagtatcaaattcgtgaaattactatcccactttttacccggcagttattaacagtaatattaatgttataaactattttaaccgcatgtttcactttttc
gaacatgaaaagagaactaactacgaatacgaaagaggaaatattataatttttcccctagcactgtattctgcagataaagtagataccgagttagc
tatcaaattaggatttaaatctttggtacaatacataaagtttatcttttttacagatggctctgttatacattaaaatttacgaactaccatgctgcgacaa

FIG. 13M cttttttacacgcagatcttaaacccgataatatcttactttttgattccaatgaaccaataataattcatctaaaggataaaaagtttgttttttaatgaacg
tattaaatcggcattaaacgactttgactttttcccaagtggctggaatcattaacaagaaaataaaaaacaatttcaaagttaaacataactggtatta
cgatttccatttcttttgttcatactttattaaaaacatatccagaaatcgaaaaagatatcgaatttagtacagcattagaagaattcatcatgtgtacca
agacagactgtgataaatatagattaaaggtttccattcttcacccaattagtttcttggaaaaatttattatgagagacattttctcagactggataaat
ggcggaaactaa >Gene72:33786..33935, 150 bp atgtataacagagccatctgtaaaaagataaactttatgtattgtaccaaagatttaaatcctaatttgatagctaactcggtatctactttatctgcaga
atacagtgctaggggaaaaattataatatttcctctttcgtattcgtag >Gene73:34639..34878, 240 bp atgaatcattggcaacacccatttattgtacaaaaagccccaatttacaaacgaaagtccaggtttgatagagacaaactattaactattttgtctctgt
ttttaatttctttagtaatgaaattattcacaatatcagtatcttctttatctaccagagattttactaacttgataaccttggctgtctcattcaatagggta
gtaatatttgtatgtgtgatattgatatcttttttga >Gene74:34683..35729, 1047 bp atggggtttttgcattccattgagatcaaagatgttgaagagagaggatctagaaaatcctcttccatactggctaggcgtcctactcctaaaaaaatgaac
atagttactgatttggaaaatcgtttaaagaagaatagctatatagaaaatactaatcagggaaacattctgatggatagcatcttcgtatccactatg
ccggtagaaacattgtttggatcgtacataactgatgacagtgatgattatgaacttaaggatttactcaatgttacatataacattaaaccggtcatag
ttcctgacatcaagttagatgctgtattagatagagatggaaattttagaccagctgactgtttcttggttaaactgaaacatagagatggattcaccaa
aggagctctctatcttggtcacagtgcaggatttacggcaacaatctgcttaaaaaatgagggggtttcagggctttacattccaggtacttctgtaatt
cggtccaatatctgtcaaggagatactatcgtcagtagatcatctagaggagttcaatttcttccacaaataggaggagaagctatcttcttgattgtttc
actttgtcctaccaaaaagttagtagaaacaggattcgtcattccagaaatatcgtcaaatgataacgccaaaatcgctgctcgcattctatcagagaa
acgcaaggacaccattgcgcatattaatactctaatacaatacaggcaacaattggaattggcttactataattcctgcatgttaaccgagtttctgcat
tattgtaattcgtatgctggcaccatcaaagaatcacttctaaaagaaacaattcaaaaagatatcaatatcacacatacaaatattactaccctattg
aatgagacagccaaggttatcaagttagtaaaatctctggtagataaagaagatactgatattgtgaataatttcattactaaagaaattaaaaacag
agacaaaatagttaatagtttgtctctatcaaacctggactttcgtttgtaa >Gene75:35017..35178, 162 bp atggtgtccttgcgtttctctgatagaatgcgagcagcgattttggcgttatcatttgacgatatttctggaatgacgaatcctgtttctactaactttttgg
taggacaaagtgaaacaatcaagaagatagcttctcctcctatttgtggaagaaattga >Gene76:35629..35790, 162 bp atgttcatttttttaggagtaggacgcctagccagtatggaagaggattttctagatcctctcttcaacatctttgatctcaatggaatgcaaaaccccat
agtgaaacaaccaacgataaaaataatattgtttttcacttttttataattttaccatctga >Gene77:35772..37679, 1908 bp atgttaaacagggtacaaatcttgatgaaaacagctaacaattatgaaactattgagatattgcgtaactatttaagactgtatatcattttggcacga
aatgaagaaggtcatggtatactaatatacgatgataacatagatagtattatgtcgatgatgaatattacaagattagaagttataggattgacgact
cattgcacaaaattaagatcatcgcctccaattcctatgtctagattgtttatggacgaaatagatcatgagtcatattattctccaaaaacttcagatta
tccgttgatcgatattatacgaaagcgttcccacgaacaggggagatatagcactggctttagaacaatacggtatcgagaatacagattccatatcag
aaaattaatgaatggttgtcgtcaaaaggtttagcatgttatagatttgtaaaatttaacgattacaggaaacagatgtatcgtaagttctctaggtgtac
tatagttgacagtatgataataagggcatataggtcatcattatatttggattaaaaatttagaaacatatacgcgtcccgaaattgatgtgttaccgtttg
atattaaatacatatctagagatgaattgtgggcgcgaatttcttcctcgttagatcaaacacatataaaaaccatcgccgtatcagtttatggagctat

FIG. 13N tactgataatggaccaatgccatatatgatatccacgtatccgggtaataccctttgttaactttaacagtgtaaaagatctaattttatatttcttagattg
gattaaagatattatgactagtacacgaactatcattctagtaggttacatgagtaatctattcgatataccgttgctaacagtatactggcccaataac
tgtggatggaaaatctataataatacattaatatcatccgatggtgctagggttatttggatggatgcgtataaattttcttgcggtttatctttacaagac
tattgttatcattggggtagcaaaccagagagccgaccattcgatttaataaaaaaatcagatgctaaacgcaattctaaatcgttggtcaaagaatct
atggcatccttgaaatccttgtacgaggcattcgagacacaatcaggagcgttagaagttttaatgagtccatgtaggatgttttcgttttctagaatag
aagacatgttcttaactagtgtcattaatagagtatccgagaatactggaatggggatgtattatcctaccaacgatataccttttctatttatcgaatca
tctatctgtctagattatattatagtaaataatcaggaatccaacaaatatcgtatcaaatctgttctcgatatcatttcttcaaaacaataccctgcagg
acgtcccaactacgttaaaaatggtacaaaaggaaagttatatatcgcgttgtgtaaagttaccgtacctactaacgaccatattccagtagtttatca
cgatgatgacaatactaccacctttattacagtattgacgtccgtcgatattgaaactgctatcagagcaggatattcgatagtcgaattaggggcttta
caatgggatgataatattccagaacttaaagactgtttactggatagtatcaagatgatttatgacttgaacgcagtcacaacaaataatttattggaa
cagctcatagaaaatattaactttaacaactctagtataatttcgttgttctatacatttgccattagttattgccgagcattcatttactcaattatggaa
accatagatccggtgtatatatctcagttcagttatataagaattatacgttagtagctcttataaagatattaatgaatccatgagtcagatggtaaaat
tataa >Gene78:36454..36669, 216 bp atgacactagttaagaacatgtcttctattctagaaaacgaaaacatcctacatggactcattaaaacttctaacgctcctgattgtgtctcgaatgcct
cgtacaaggatttcaaggatgccatagattctttgaccaacgatttagaattgcgtttagcatctgatttttttattaaatcgaatggtcggctctctggtt
tgctaccccaatga >Gene79:36844..36993, 150 bp atgatagttcgtgtactagtcataatatctttaatccaatctaagaaatataaaattagatcttttacactgttaaagttaacaaaggtattacccggata
cgtggatatcatatatggcattggtccattatcagtaatagctccataa >Gene80:37713..38831, 1119 bp atgtggccatttgcatcggtacctgcgggagcaaaatgtaggctggtagaaacactaccagaaaatatggattttagatccgatcatttaacaacattt
gaatgttttaacgaaattatcactctagctaagaaatatatatacatagcatctttttgttgtaatcctctgagtacgactaggggagcgcttatttttgat
aaactaaaagaggcatctgaaaaagggattaaaataatagttttgctagatgaacgagggaaaagaaatctgggagagctacaaagtcactgcccg
gatataaattttataaccgttaatatagataaaaaaaataatgtgggactactactcggttgttttttgggtgtcagatgatgaaagatgttatgtaggaa
acgcgtcatttactggaggatctatacatacgattaaaacgttaggtgtatattctgattatcccccgctggccacagatcttcgtagaagatttgatact
tttaaagcctttaatagcgcaaaaaattcatggttgaatttatgctctgcggcttgttgtctgccagttagcactgcgtatcatattaagaatcctataggt
ggagtgttctttactgattctccggaacacctattgggatattctagagatctagataccgatgtagttattgataaactcaggtcagctaagactagtat
agatattgaacatttggccatagttcccactacacgtgtcgacggtaatagctactattggcccgacatttacaactccattatagaagcagccattaat
agaggagttaagatcagacttctagttggtaattgggataagaacgacgtatattctatggcaaccgccagaagtctagacgcgttgtgtgttcaaaat
gatctatctgtgaaggttttcactattcagaataatacaaaattgttgatagtcgacgacgaatatgttcatatcacttcggcaaatttcgacggaaccc
attaccaaaatcacggattcgtcagttttaatagtatagataaacagcttgtaagcgaggctaaaaaatatttgagagagattgggtatctagccac
agtaaatcgttaaaaatttaa >Gene81:38110..38253, 144 bp atggccaaatgttcaatatctatactagtcttagctgacctgagtttatcaataactacatcggtatctagatctctagaatatcccaataggtgttccgg
agaatcagtaaagaacactccacctataggattcttaatatga >Gene82:38849..39070, 222 bp

FIG. 13O atgaaacacagattgtattctgaaggattgagtattagtaatgatttaaactcgataatcggtcaacaatctacaatggatacggatatagaaataaa
cgaagatgacatcatggaacttcttaatatattgactgagttaggttgtgatgtcgactttgatgaaaattttagcgatatagccgatgatattctagaat
cgttgatagaacaggatgtataa >Gene83:39120..39269, 150 bp atggtcatcggtttagtcatattcgtgtctgtggcggccgccatcgtcggtgtgttgtctaacgtattggacatgtttatgtacgtagaagaaaataatga
agaggatgctagaatcaaggaggagcaagaactactgttgctatattga >Gene84:39342..39818, 477 bp atgaggagtattgcggggctacataaattaaaaatggaaatttttaatgtagaagaattgataaatatgaaaccttttaagaatatgaataaaataac
aattaatcaaaaggataattgtatattagcaaatcgatgctttgttaaaatagatactcctagatacataccatcgacatccattagcagttctaatatc
atcagaatacggaatcatgattttacattatctgaattattgtattcaccgtttcattttcaacagcctcagtttcaatatctccttcctgggtttgtattaac
gtgtattgataaagtttcgaaacagcaaaaagaatgtaaatattgtatctctaatcgtggagatgatgatagtttaagcattaatctatttattccgact
attaacaagtctatatatattattatcggtttacggatgaaaaattttttggaagcctaaattcgaaatagaataa >Gene85:39825..40520, 696 bp atgaaagtggtgattgtgactagcgtagcatcgcttctagacgcatctattcagtttcaaaaaaacggcatgtaggcatcactgtaattacctatctatgc
aagtagttaaagagatagaagaatttggtactatcaatgaaaaaaatttggaatttgacacttggaaagacgttatacaaaacgatgaaatagatgc
attagtattttatagagtaaaacaaattagtatttctacgggtgttctatataaatctatgatgcgcaatagaacaaaacctatttccatgtactttgtac
gtgattgtttggcatttgatggagatcctccgtcttttagaatgacgtcttgcaatatcaacgcatacaatcgtaataagattaaagatttgataatccta
atgaatatgaaaacatgcaataaaaaaattatcggtgagtttataatagacaattttggaagcgtcgatgcattactatcgataattaattctaatgtta
cgtggattacatcagttatataatagtaacggcaggggtattaatatcagggtatcaaataataaaatgttaactataactagttttcgacgatttgt
caataaacttaaaatgtacaaaactactaaatgcgcttctcaattggataatctatgtaccgagatgaacaaaatggatattatagacaaaaaatga >Gene86:40583..40888, 306 bp atgaattctcattttgcatctgctcatactccgttttatatcaataccaaagaaggaagatatttggttctaaaagccgttaaagtatgcgatgttagaac
tgtagaatgtgaaggaagtaaagcttcctgcgtactcaaagtagataaaccctcatcacccgcgtgtgagagaagaccttcgtcccttccagatgcg
agagaatgaataacccaggaaaacaagttccgtttatgaggacggacatgctacaaaatatgttcgcggctaatcgcgataatgtagcttctagactt
ttgtcctaa >Gene87:40618..40830, 213 bp atgtccgtcctcataaacggaacttgttttcctgggttattcattctctcgcatctggaaggggacgaaggtcttctctcacacgcgggtgatgagggttt
atctactttgagtacgcaggaagctttacttccttcacattctacagttctaacatcgcatactttaacggctttttagaaccaaatatcttccttctttggta
ttgatataa >Gene88:40885..42324, 1440 bp atgaataggaatcctgatcagaatacttttcctaatattacattaaagattatagaaacctatttaggcagagtacctagtgtgaacgaatatcatatgt
taaaattacaagctagaaatattcaaaaaataactgtttttaacaaagacatatttgtatctttagtaaaaaagaataaaaaaagatttttttccgatgt
taatacatctgcatcagaaataaaagatcgtatacttagctacttttctaaacagactcaaacatataatataggtaaattatttacgattatagaacta
caatctgtattagtgaccacatacacggacatattaggagttcttactattaaagctccaaatgtaatttcatctaaaatttcttataatgtaacatcaat
ggaagaattggcaagagatatgctaaattcatgaacgtcgcagtaatagacaaggcaaaagtaatgggacgtcataatgtatcttccctagtcaaa
aatgttaataagttgatggaagaatatcttagacgccataataaaagttgtatatgttacggatcatattctctatatctaattaatccaaatatactata
cggcgatatagatattcttcagactaattctaggacttttcttatagatttggcctttctaataaaatttatcacgggaaataatattatattaagtaaaat
cccatatcttagaaactatatggtgataaaagatgaaaacgataatcatatcattgatagttttaatattcgccaggataccatgaacgtagttcctaa

FIG. 13P aatctttatagataatatctatatagtggatccgacgtttcaactattgaacatgataaaaatgttttctcaaatagatagattggaagatctatccaaa
gatcctgaaaagtttaatgcgcgtatggcaaccatgctagaatacgttagatatacacatggtatagtctttgatggtaagcgtaataatatgccgatg
aaatgtatcatcgatgaaaataatcgcatagttactgtcactactaaagactattttagctttaaaaaatgtctagtgtatctagatgaaaatgtgttatc
gagtgatatattagatcttaacgccgacacatcgtgtgatttcgagagtgttacaaattctgtatatctaattcatgataatatcatgtatacatatttctc
aaatactattctccttagtgataaggggaaggtacatgaaataagtgccagaggtttatgtgtgcacatatattgttgtatcagatgctgacatctggaga
atacaaacaatgtttatcggatctcttaaattcgatgatgaatagagataaaataccatctcattcacatactgaaagagataaaaaacctggacgac
acggatttattaatatcgaaaaggatataatagtattttag >Gene89:42321..44534, 2214 bp atgatatctgtcacagatattcgtagagcgtttctagacaatgaatgccatactatcacaaaagcgtttggatatctgcacgaggacaaggctatcgca
ttaattaaaataggatttcatcccacttatctacccaaagtcctttataataatgttgtagaattcgttccagaaaaactatatctgtttaagccaagaac
tgtagctccattggatttgatatctactataacaaaattaaagaacgtggacaaatttgcctcacacataaattatcacaagaatagtatattgataac
aggagacaagtctctaattgttaaatgtatgccttacatgattatttcagatgatgatatacgattcataagagaacagtttgttggtacaaattctattg
agtatattctatccttcatcaacaaggaaagcatatatagaatgagttaccaattttcagagaatgaaatagtcactatcatcaatagagatcatttcat
gtatgaaccaatatatgaacatcaagtcttagattctgactttcttaaaactatgttagatagatacggaatagttcccattaattctggtataatagatg
aattatgtccagaagctataatagagatattaatggcagtagttcgtcctagggacgctatccgtttcttagatatagtgaataagaatcaattgacag
aagatagtgtcaaaaactatatcattaatgatatcagaagaggtaaaatagattattatattccatacgttgaagatttttagaagatagaactgaag
acttgggaatatatgcgaatatattttttgaggatgctatagatattacgaaactagacatcacaaagacagagttggaacatatatcaaaatacatg
aattattacactacttatatagatcacatagttaacatcatcttacaaaataattatatagatatcttggcatctataatagattacgtgcaagacgtatt
aacagaagaattatgtattagaatagtttgcgaatcaacaaaccctgttcccgttacatctcttcctatacattctacgttagtaatggttatgtgtatac
aaatgaaatatgtcgatatagttgaattcttagacgagatcgacatcgatactttaatagaaaaaggagcagatccgataaccgaatacacatttaca
acaagatggtacaataaacacaatgatttgatcactctttacattaaaaaaatatggattctgtccaatgatgatgaaacggttaatgttcgaatatccat
tgactaaagaagccagtgatcatttacttaaaaccatggatgaaaacaggggagctattatgttttttccgcgtactatttgcacacttccttatctatta
tgttgtaattataaactaattcaaaaacctattccattcaaagaagaaatcgtaacatcgtatataagaaaaacaacagagtattatgctttgactcg
ttggagaactctgcgtttaaaagcctcattaaaatagattctattccaggattaaaaacttataacatgaaagacattacatacgaaaagtctaataat
ataatttgtgttaggtttatacctcaagaatcaattcataatgaagagcgaagaataaaattacagttattcgacattgctagattggcatcctatggac
tatattatattccctctagatatttatcatcgtggacaccagtagtgaacatgatagagggaagagagtacactaatccacaaaaaatagaatgtctag
ttattttggatttattttcagaggaattcatagaatatcaaaatctgggcaatgcggtatctaataaatatgaactggaatatactatatctaattatcaa
gctgccataaactgcctaatgagcacgttattaatatatctagttctaggatcaatcagatcgatatcaaaaactgaagattttgtattatctatattaaa
tatcttctataaaggactgaaaattaatgaattactttctgaaccagtatcaggagtttgtatcgaattagataaaataaaagatagagcgagctctgg
agacagtagttttatatttcttaagaaaaacgagttatcaaaaactctatcgctctgtgaaaaagtttgcgtagagaccatattagacaataatcagag
ttttaaatcctcaaaatga >Gene90:42358..42531, 174 bp atggtctctacgcaaacttttttcacagagcgatagagtttttgataactcgtttttcttaagaaatataaaactactgtctccagagctcgctctatcttt
attttatctaattcgatacaaactcctgatactggttcagaaagtaattcattaattttcagtcctttatag >Gene91:42709..42834, 126 bp atgaattcctctgaaaataaatccaaaataactagacattctatttttttgtggattagtgtactctcttccctctatcatgttcactactggtgtccacgatg
ataaatatctagagggaatataa >Gene92:44661..45233, 573 bp atgtctaagatctatattgacgagcgttctgacgcagagattgtgtgtgcggctattaaaaacattggaatcgaaggagctactgctgcacaactaact
agacaacttaatatggagaagcgagaagttaataaagctctgtacgatcttcaacgtagtgctatggtgtacagctccgacgatattcctcctcgttgg

FIG. 13Q tttatgacaacggaggcggataagccggatgctgatgttatggctgacgccataatagatgatgtatcccgcgaaaaatcaatgagagaggatcata
agtcttttgatgatgttattccggctaaaaaaattattgattggaaagatgctaaccctgtcaccattattaatgagtactgccaaataactaagagaga
ttggtcttttcgtattgaatcagtggggcctagtaactctcctacattttatgcctgtgtagatatcgacggaagagtattcgataaggcagatggaaaat
ctaaacgagatgctaaaaataatgcagctaaattggcagtagataaacttcttggttacgtcatcattagattctga >Gene93:45288..46067, 780 bp atggaaaatgtatacattagtagttactcatccaatgaacaaacatcaatggcggtagccgctactgatatccgagaattactatcacaatatgtggat
gatgccaacttggaagacttaatagaatgggccatggaaaaatcatcaaagtactacatcaagaatataggtaatacaaaatctaatatcgaagaaa
ctaaattcgaatcaaagaataatattggtatagaatactcaaaggattccagaaacaaactatcgtatagaaataaaccgtctattgccacaaatttg
gaatataaaacactatgtgatatgattaagggtactagcggcaccgaaaaagaattccttcgctatctcttattcggtataaaatgcattaagaaagga
gtagaatacaatatagataaaataaaggatgtgagttacaacgattattttaacgttctcgacgagaaatacaatacaccgtgtcctaactgtaaaag
taggaatactacgccgatgatgattcaaactagagccgctgacgaacctccactagttagacatgcgtgtagagattgcaaacaacactttaagcctc
ccaaatttagagcatttcgcaatcttaatgttacaacgcaatcgatacatgaaaacaaggaaataacagagattcttccagataataatccatctcctc
cagaatctccagaaccagcatcacctatagatgacgggttaatcagatccacattcgatagaaacgacgaaccaccagaggatgatgaataa >Gene94:46148..47143, 996 bp atgttaataattgtattgtggttatacggctacaattttataatgagtgaaagtcagtgtccgatgatcaatgacgatagctttactctgaaaagaaagt
atcaaatcgatagtgcggagtcaacaataaaaatggataagaagaggatataagtttcagaatagagccaaaatggtaaaagaaataaatcagaca
ataagagcagcacaaactcattacgagacattgaaactaggatacataaaatttaagagaatgattaggactactactctagaagatatagcaccat
ctattccaaataatcagaaaacttatatatactattctcggacatttcagccatcggcaaagcatcacagaatccgagtaagatggtatatgctctgctgc
tttacatgtttcccaatttgtttggagatgatcatagattcattcgttatagaatgcatccaatgagtaaaatcaaacacaagatcttctctcctttcaaac
ttaatcttattagaatattagtggaagaaagattctataataatgaatgcagatcaataaatggaaaataattggaacacaagttgataaaatgttga
tagctgaatctgataaatatacaatagatgcaaggtataacctaaaacccatgtatagaatcaagggagaatctgaagaagatacctcttatcaaa
cagatggtagaacaatgtgtgacatcccaggaattggtggaaaaagtgttgaagatactgtttagagatttgttcaagagtggagaatacaaagcgt
acagatacgatgatgatgtagaaaatggatttattggattggatacactaaaattaaacattgttcatgatatagttgaaccatgtatgcctgttcgtag
gccagtggctaagatactgtgtaaagaaatggtaaataaatactttgagaatccgctacatattattggtaaaaatcttcaagagtgcattgactttgtt
agtgaatag >Gene95:46675..46995, 321 bp atgtttaattttagtgtatccaatccaataaatccattttctacatcatcatcgtatctgtacgctttgtattctccactcttgaacaaatctctaaacagtat
cttcaacacttttttccaccaattcctgggatgtcacacattgttctaccatctgtttgataaagagggtatcttcttcagattctcccttgattctatacatg
ggttttaggttataccttgcatctattgtatatttatcagattcagctatcaacattttatcaacttgtgttccaattattttccatttattagatctgcattca
ttattatag >Gene96:47280..48983, 1704 bp atggatttattcgtagaaagtatcttatatacacagtagaaaataatatagatttttaaaggatgatacattaagtaaagtaaacaattttaccctca
atcatgtactagctctcaagtatctagttagcaattttcctcaacacgttattactaaggatgtattagctaataccaattttttgttttcatacatatggt
acgatgttgtaaagtgtacgaagcggttttacgacacgcatttgatgcacccacgttgtacgttaaagcattgactaagaattatttatcgtttagtaac
gcaatacaatcgtacaaggaaaccgtgcataaactaacacaagatgaaaaattttttagaggttgccgaatacatggacgaattaggagaacttatag
gcgtaaattatgacttagttcttaatccattatttcacggaggggaacccatcaaagatatggaaatcatttttttaaaactgtttaagaaaacagactt
caaagttgttaaaaaattaagtgttataagattacttatttgggcatacctaagcaagaaagatacaggcatagagtttgcggataatgatagacaag
atatatatactctatttcaacaaactggtagaatcgtccatagcaatctaacagaaacgtttagagattatatctttcccggagataagactagctattg
ggtgtggttaaacgaaagtatagctaatgatgcggatatcgttcttaatagacacgccattaccatgtatgataaaattcttagttatatatactctgag
ataaaacagggacgcgttaataaaaacatgcttaagttagtttatatctttgagcctgaaaaagatatcagagaacttctgctagaaatcatatatgat

FIG. 13R attcctggagatatcctatctattattgatgcaaaaaacgacgattggaaaaaatattttattagtttttataaagctaattttattaacggtaatacattt
attagtgatagaacgtttaacgaggacttattcagagttgttgttcaaatagatcccgaatatttcgataatgaacgaattatgtctttattctctacgag
tgctgcggacattaaacgatttgatgagttagatattaataacagttatatatctaatataatttatgaggtgaacgatatcacattagatacaatggat
gatatgaagaagtgtcaaatctttaacgaggatacgtcgtattatgttaaggaatacaatacatacctgtttttgcacgagtcggatcccatggtcatag
agaacggaatactaaagaaactgtcatctataaaatccaagagtagacggctgaacttgtttagcaaaaacattttaaaatattatttagacggacaa
ttggctcgtctaggtcttgtgttagatgattataaaggagacttgttagttaaaatgataaaccatcttaagtctgtggaggatgtatccgcattcgttcg
attttctacagataaaaaccctagtattcttccatcgctaatcaaaactattttagctagttataatatttccatcatcgtcttatttcaaaggtttttaaga
gataatctatatcatgtagaagaattcttggataaaagcatccatctaaccaagacggataagaaatatatacttcaattgataagacacggtagatc
atag >Gene97:49065..49565, 501 bp atgggaactgctgcaacaattcagactcccaccaaattaatgaataaagaaaatgcagaaatgattttggaaaaaattgttgatcatatagttatgtat
attagtgacgaatcaagtgattcagaaaataatcctgaatatattgattttcgtaacagatacgaagactatagatctctcattataaaaagtgatcac
gagtttgtaaagctatgtaaaaatcatgcagagaaaagttctccagaaacgcaacaaatgattatcaaacacatatacgaacaatatcttattccagt
atctgaagtactattaaaacctataatgtccatgggtgacataattacatataacggatgtaaagacaatgaatggatgctagaacaactctctaccct
aaactttaacaatctccgcacatggaactcatgtagcataggcaatgtaacgcgtctgttttatacatttttttagttatctgatgaaagataaactaaat
atataa >Gene98:49286..49498, 213 bp atgctacatgagttccatgtgcggagattgttaaagtttagggtagagagttgttctagcatccattcattgtctttacatccgttatatgtaattatgtca
cccatggacattataggttttaatagtacttcagatactggaataagatattgttcgtatatgtgtttgataatcatttgttgcgtttctggagaacttttct
ctgcatga >Gene99:49690..50511, 822 bp atggctgccaccgttccgcgtttgacgacgtgtacaaaaatgcacaaagaagaattctagatcaagaaacatttttagtagaggtctaagtagacc
gttaatgaaaaacacatatctatttgataattacgcgtatggatggatccagaaactgcaatttggagtagtagatacgcaaacttagatgcaagtg
actattatcccatttcgttgggattacttaaaaagttcgagtttctcatgtctctatataaaggtcctattccagtatacgaagaaaaagtaaatactgaa
ttcattgctaatggatcgttctctggtagatacgtatcatatcttcgaaagttttctgctcttccaacaaacgagtttattagttttttgttactgacttccat
tccaatctataatatcttgttctggtttaaaaatactcagtttgatattactaaacacacattattcagatacgtctatacagataatgccaaacacctgg
cgttggctaggtatatgcatcaaacaggagactataagcctttgtttagtcgtctcaaagagaattatatatttaccggtcccgttccaataggtatcaa
agatataaatcaccctaatcttagtagagcaagaagtccatccgattatgagacattagctaatattagtactatattgtactttaccaagtatgatccg
gtattaatgttttttattgttttacgtacctgggtattcaattactacaaaaattactccagccgtagaatatctaatggataaactgaatctaacaaagag
cgacgtacaactgttgtaa >Gene100:49890..50090, 201 bp atggaagtcagtaacaaaaaactaataaactcgtttgttggaagagcagaaaactttcgaagatatgatacgtatctaccagagaacgatccattag
caatgaattcagtatttactttttcttcgtatactggaataggacctttatatagagacatgagaaactcgaacttttttaagtaatcccaacgaaatggg
ataa >Gene101:50518..53538, 3021 bp atggatgttcggtgcattaattggtttgaaagtcacggtgaaaacagattttttatatctgaaatccagatgtcgaaatggtgagaccgtatttatacgat
ttcctcattactttttattacgtagtgacggacgaaatatatcagtcattgtctcctcctccatttaatgcgaggccgttgggaaagatgagaactatagac
attgacgagacaataagttataatctagatattaaagatagaaaatgctccgtcgcagatatgtggttgatagaagagccaaagaaacgcagcatac
aaaatgccaccatggatgaatttctcaatattagttggttttatatttctaacgggatatctccagacggatgttactcgttggacgagcaatatttgaca

FIG. 13S aagattaacaatggatgttatcattgtgacgatccacgtaactgtttcgctaaaaaaatacctagattcgatatcccaagatcgtacttatttctagatat
agagtgtcacttcgataagaagtttccttctgtatttattaacccaatctcgcatacaagttactgttatatcgatttaagtggtaaacgattattgtttac
gctcattaatgaagagatgttaacggaacaggaaatacaagaagccgtcgatagaggatgtttgaggatacagtcactaatggaaatggattacga
acgagaactagttttatgttctgaaatagtttttgttacgaatagctaaacaattgttggaactaacgttcgactatgtcgttacctttaacggacataact
ttgatctgagatatattactaatcgtctagagttattaacaggagagaagattatctttagatctccggacaaaaaggaagctgtacatctctgtatttat
gagagaaatcagtctagtcataagggagtaggcggcatggccaatactacgtttcacgttaataacaataatggaactatattttcgatctatattcat
tcattcaaaaatctgaaaaattggattcgtacaaattggattctatatccaagaacgcgttcagttgcatgggtaaagtattaaatagaggagttagag
aaatgacgttcatcggtgacgatactacggacgcgaaaggcaaagccgctgcatttgcaaaggttttaaccacaggtaattatgtgactgttgatgag
gatattatatgtaaagtaattcgtaaagatatttgggaaaatggatttaaagtcgtactattatgtcctactttacctaatgatacatataaattatctttc
ggaaaggatgacgttgatttagctcagatgtataaggattataatctaaacatagctttagatatggctagatactgtattcatgatgcttgtttgtgtca
gtatttgtgggagtattatggagtagaaacaaaaacagacgcgggtgcgtcaacatatgtgcttcctcaatccatggtattcgaatatagagcgagta
cagtcatcaagggtccactgttaaagctattgttggaaactaaaactatcttagttagatcagaaacaaaacaaaagtttccttatgaaggcggtaag
gtatttgctccaaaacaaaaaatgtttagtaataatgtattaatctttgattataacagtctgtatcctaatgtgtgtatctttggaaatctatctccggaa
acattagtcggtgtcgttgttagtaccaatagattggaagaagaaataaataatcagctcttgcttcagaaatatccacctcctagatatattacggttc
attgtgaacctagactaccgaacctcatctctgaaatagcaattttcgatagatcgatagaaggaaccattcctagactattaagaacatttttggcag
agagagccagatataaaaagatgttaaaacaggctaccagttcaactgaaaaggccatctatgattccatgcaatatacgtacaagatagtagccaa
ctcagtatatggtctgatgggatttagaaatagtgctctatactcatacgcttcggctaagagttgcacatccataggacgtagaatgatcttgtatcta
gaatcggtactaaatggagcagagttatctaacggtatgttacggtttgccaatccattaagtaatccattttatatggacgatagagatattaatccga
ttgtgaaaacatcgttgcctatagattacagatttcgttttcgtagcgtgtatggagataccgactccgtgtttacagagatagacagtcaagatgtaga
taagtccatagaaatagcaaaggagttagaacgactgattaataatagagtattgtttaataattttaaaatagagtttgaggcggtatataagaatct
gattatgcaatcgaagaagaaatatacaacgatgaaatactcggcatcgtcgaattcaaaatctgtacctgagagaattaataaaggtactagtgaa
actagaagagatgtttccaagtttcataagaatatgattaagacatacaagaccagactgtctgagatgttgtctgaaggacggatgaattctaatca
ggtatgtatagatattctccgttctttagaaacagatttacgatccgaatttgatagtagatcgtctcctctagaattatttatgttgagtcgaatgcatca
ctcaaattataaatccgcagataaccctaatatgtatttggttactgaatataataaaaataatccagaaactatagaacttggagaacgatattattt
gcatatatttgtccggctaatgtaccatggaccaaaaaacttgtaaatattaaaacatatgaaacaattatcgatagaagtttaaactcggcagtgat
caaagaatatttacgaagtttactttaaacgattgacgtccgaaatagtcaatcattggataataaagtttatgcatctcattctttgaaagaatgttt
ggttcaaaacctacattttacgaagcataa >Gene102:51584..51742, 159 bp atggcctttcagttgaactggtagcctgttttaacatcttttatatctggctctctctgccaaaaatgttcttaatagtctaggaatggttccttctatcga
tctatcgaaaattgctatttcagagatgaggttcggtagtctaggttcacaatga >Gene103:53116..53313, 198 bp atgataacatccattgttaatctttgtcaaatattgctcgtccaacgagtaacatccgtctggagatatcccgttagaaatataaaaccaactaatattg
agaaattcatccatggtggcattttgtatgctgcgtttctttggctcttctatcaaccacatatctgcgacggagcattttctatctttaatatctag >Gene104:53566..53748, 183 bp atgacattattgtcctctatagcgatagtcgcgtgccgtctacatgcaggacatggaagagtgctaactatagtatatagttttcgtttacacgcttctat
gttgccgtctaaacccgcttgcgaaagtactataaaaataatggtccatacggctcttccccaatgtttgggattcatttaa >Gene105:53570..53857, 288 bp atgaatcccaaacattggggaagagccgtatggaccattatttttatagtactttcgcaagcgggtttagacggcaacatagaagcgtgtaaacgaaa
actatatactatagttagcactcttccatgtcctgcatgtagacggcacgcgactatcgctatagaggacaataatgtcatgtctagcgatgatctgaat
tatatttattattttttttcatcagattatttaacaatttggcatctgatcccaaatacgcgatcgatgtgacaaaggttaaccctttataa

FIG. 13T

>Gene106:53852..54241, 390 bp atggaactcgttaatatttttttagaaacggatgctggaagagtaaagtttgccataaaaaataccgacgatgtatgtgcctcggagttaataaataaa
tttgtggaactgttaagtgaatacattcacattgaccaatcagaattttatttggtggtaaaggataaggatattttttattttaagtgtgataggggggtct
atttcgattgtaaacaatgagtttatgtctttgacgaacccttgctgtttgttaaagatttcactaatgtaacgggggttgaattcatagtcacagaaac
catgccgtgtagaattataccaaaaaataatcacgcggttatttcagtcgtgactaatcataagttttataatgggttaagtttataa >Gene107:54117..54263, 147 bp atgtattcacttaacagttccacaaatttatttattaactccgaggcacatacatcgtcggtattttttatggcaaactttactcttccagcatccgtttcta
aaaaaatattaacgagttccatttatatcatccaatattattga >Gene108:54228..56228, 2001 bp atgttcatgtatccggaatttgcgaggaaggctttatcaaagcttatttcaaaaaaattaaacattgaaaaggtgtctagcaagcaccagctcgtgtta
ctggattatggattacacggactattgccaaaatcactgtatctggaagctattaattccgatattctcaatgttaggttttttcctcctgaaataataaac
gtcactgatatcgttaaggctctccaaaattcttgtagagtagatgagtacctaaaatctgtttccttatatcataagaattctttaatggtatcgggacc
aaatgtagtcaagcttatgatagaatataatcttcttacacacagtgacttggaatggttaattaatgagaatgtagtcaaggctacataccttttaaaa
atcaatgcctatatgattaactttaaaatagatctaacggttgatgaaatcattgacttagttaaagatattcctgtaggagctacactacatctatataa
tatattaaacaatatagatttggacattgttcttcgtatatctgatgaatataatataccacctgttcacgatattctgtctaaacttaccgatgaagagat
gtgtataaaactagttacaaagtatcctatggacaatgttatataattttattaatcaagatgttagatatagtcccaccttcatcaagacaattaaagat
tttgtcaacgagcatcttccaaccatgtacgatggattaaatgattatctacattctgttattatcgacgaggacttaatagaggaatataaaattaaat
ccgttgccatgtttaatttggaatacaaaactgatgtaaatactctaacattggacgaacagatatttgtagaggtaaacatctcatattatgattttag
atatagacaatttgccgatgaatttagagattacattatgataaaagaagaagacaaatcaccatgcaatctggtgatagaataagaaggtttaga
cgtcccatgtcattgagatccactatcatcaaaaaggatactgattctctagaggatattctcgcacatatagataatgccagaaaaaatagcaaggt
atccattgaagatgttgagagaatcatttcatctttccgtcttaatccttgtgttgtcagacgcaccatgctgtctgatatagatatcaaaacaaagataa
tggtgctaaaaattgtcaaagattggaaatcttgtgctctgacactatcagccatcaaaggaattatggtaacagataccatcaataccgtgttatcca
aaattctgcatcatcataggaatgtcttcaagtatcttacatctgtagagaataaagaaattgctgtctgtaattgctccagatgtctgtcgctcttctata
gagaattaaaaagtgtacgatgtgatctacgcacagacgatggattattggataggctatacgatctgactagatacgccttacacggaaaaatcaat
caaaacttaatcggtcaacgatgttggggtccgttgacagaaatgctgtttaacgagaataaaaagaaaaaactaaataatttaatggaatacatca
aaatatcagacatgttggtatacggacactccatcgagaagacgcttattccaattactgattctctttcattcaagctatctgttgataccatgtctgtgt
taaatgatcaatatgccaaggttgtcatcttcttcaataccatcatagaatatattatagctactatctattatagattgacagtcttgaacaattatacta
atgtcaaacattttgtatccaaagtgttacacactgtcatggaagcatgtggcgtactgttttcatacattaaagttaatgacaaaatagagcatgaatt
ggaggagatggtggacaaaggtaccgtaccttcttatttgtatcatttgtccatcaacgtcatttcaataatattggatgatataaatggaactcgttaa >Gene109:54538..54714, 177 bp atggtatcaacagatagcttgaatgaaagagaatcagtaattggaataagcgtcttctcgatggagtgtccgtataccaacatgtctgatattttgatgt
attccattaaattatttagttttttctttttattctcgttaaacagcatttctgtcaacggaccccaacatcgttga >Gene110:54946..55293, 348 bp atggtatctgttaccataattcctttgatggctgatagtgtcagagcacaagatttccaatctttgacaattttttagcaccattatctttgttttgatatctat
atcagacagcatggtgcgtctgacaacacaaggattaagacggaaagatgaaatgattctctcaacatcttcaatggataccttgctatttttctggc
attatctatatgtgcgagaatatcctctagagaatcagtatcctttttgatgatagtggatctcaatgacatgggacgtctaaaccttcttattctatcacc
agattgcatggtgatttgtcttctttctttttatcataatgtaa

FIG. 13U

>Gene111:56276..56602, 327 bp atggccgaggaatttgtacaacaaaggttggccaataacaaagtgacaatttttgtcaagtatacatgtccttttgtagaaatgcactggatattctaa
ataagtttagtttcaaaagaggagcgtatgaaattgtcgatattaaagaatttaaacccgaaaatgaattgcgtgactattttgaacaaattactggtg
gtagaactgttcctagaatctttttgggaaaacttctattggtggatatagcgacctgttggaaatagacaacatggacgcattgggtgatattctatc
atctattggggtattgagaacttgttga >Gene112:56748..57686, 939 bp atggcggaatttgaagatcaactcgttttcaatagtatcagtgcccgtgcattgaaagcttatttcactgctaaaatcaatgaaatggtagatgagttgg
tcacaagaaaatgtccacaaaagaaaaaatcacaagctaagaaacctgaagtacgcattcctgtagatcttgtaaagtctagttttgtgaaaaagttt
ggattgtgcaattatggaggaatccttatcagtcttattaatagtctagtagaaaataatttctttacaaaggatggaaaactggatgatacaggcaaa
aaggaattggttttgacagatgtcgaaaaacgaattcttaataccatagataaatcatctcctttgtatatcgatattagtgatgttaaagtattggctgc
tagactaaaaagaagcgctacacaatttaactttaatggacatacatatcatctggaaaatgataaaatagaagatctcattaatcagttggttaagg
acgaatccattcaactggatgaaaagagttctattaaagatagtatgtatgtcattcccgatgaacttatcgatgttctcaaaactagattgtttagatct
cctcaagtcaaggataaatattatttcgcgtactagattgtatgattattttactagagttactaagagagacgaatcgtcaatctatgtgattctaaagga
tcctaggatcgctagcattttgtcactagaaactgttaaaatgggcgcctttatgtatacaaaacatagtatgttgacgaacgctatttcatctagagtcg
atagatattctaaaaagtttcaagaatcttttttacgaagatattgcagaatttgttaaagaaaatgagagagttaatgtatcgagagtggttgaatgttt
gactgtgcctaatattactatatcaagtaatgctgaataa >Gene113:57693..57914, 222 bp atggataagttgtacgccgctatatttggtgtatttatggggtctccggaagatgatttgacagactttatagaaattgttaaatctgttctaagtgatga
gaaaacagtcacatcaactaataataccggttgttggggttggtattggttaattattattttttttatagttcttattctactactattgatatatttgtattt
aaaagttgtttggtga >Gene114:57915..58724, 810 bp atgagtaaggtaatcaagaagagagttgaaacttcaccaagacctactgcatctagcgattctctacagacttgtgcgggtgttatagagtatgcaaa
atcgattagtaaatctaatgcaaaatgtatcgaatacgttacactaaatgcttctcaatacgctaattgttcgtctatctctataaaacttactgatagtttt
atctagtcaaatgacttccactttattatgttggaaggagagactaaactttataaaaataaatctaaacaagatagaagcgatggatactttctaaa
aataaaagttaccgcggctagtcctatgttgtatcaacttctagaagccgtctatggaaacattaagcacaaggaacgcattccaaattctttgcatagt
ctttcggtggaaactattacagagaaaacatttaaggatgaatccatcttcatcaacaaattaaacggagccatggtagaatatgtttcgactggaga
atcatccattctcagatctatagaaggtgaactagaatcactcagtaaaagagaaagacaattggccaaggcaattatcacacctgtagttttctatag
atccggaacggaaacaaaaattacattcgcactcaagaaactaatcattgatagagaagtggtggctaacgttatcggactctctggagatagtgaa
cgtgtatcaatgactgaaaatgtagaagaagatctggctcgtaatctgggacttgttgatattgatgatgaatatgatgaagatagcgataaagaaaa
gccaatattcaatgtataa >Gene115:58219..58374, 156 bp atggatgattctccagtcgaaacatattctaccatggctccgtttaatttgttgatgaagatggattcatccttaaatgttttctctgtaatagtttccaccg
aaagactatgcaaagaatttggaatgcgttccttgtgcttaatgtttccatag >Gene116:58807..61122, 2316 bp atgtttgtcattaaacgaaatggatacaaggaaaatgtcatgtttgataaaatcacgtctcgtattagaaaattatgttatggcttaaacacggatcata
tagatcctattaaaatagctatgaaggttattcaaggaatatataatggagtaacaacggtagaattggacactctggcagccgaaatagcagccact
tgtactacacaacatccggattatgccattctagccgccagaatagccgtatcaaatctacacaaggaaacaaaaaaactatttagtgaagtgatgga
ggatttattcaactatgttaatcctaaaaatgggaaacattctccgattatttcaagtatcaccatggatatagttaacaaatataaggataaactcaac

FIG. 13V tcggttattatttacgaacgagacttttcatacaactattttggtttttaaaactttggaaaaatcctacttgttgaaaataaacaacaagatcgttgaaag
acctcagcacatgttaatgcgtgtcgcagtaggaattcatcaatgggatatagactcagctattgagacgtacaatctactttctgaaaaatggtttacg
cacgcttctcctaccttatttaatgcgggaactagtcgtcaccaaatgtctagctgttttctacttaacatgatcgatgatagcatagagggtatctatga
cacgttaaaacgatgcgcattaatctctaaaatggcaggggggaataggtctatcaattagtaatattcgtgccagtggaagctatatctccggtaccaa
tggtatatcaaacggtattattccaatgttgagagtttataataacaccgctagatacatagatcagggaggaaacaaacggcctggagttatggcca
tatacttggaaccgtggcattctgatattatggcgttcctcgatcttaaaaagaatacaggaaacgaggaacatagaaccagagatctatttatagctc
tttggattcctgatctctttatgaaacgagtgaaggatgacggagagtggtcgttgatgtgtccggatgaatgtcctggattggacaatgtttggggaga
cgagttcgaacgattgtatacactatacgaaagagaaaggagatacaaatctataataaaggctcgagtcgtctggaaagcgattatagaatctcag
attgaaactggtactccattcattctttataaggatgcgtgtaacaaaaagagtaatcaacaaaatttaggaactatcaagtgtagtaatctttgcactg
agataatacaatatgcggatgctaatgaggtagccgtttgtaatctggcatctgttgccttgaacatgtttgtaatagatgggcgatttgattttctcaaa
ctgaaggatgtggtcaaagtaattgtcagaaatctcaataaaattatagatattaattattatcctattccagaagctgaaatctctaataagagacat
agacctatcggtattggtgttcaaggattagcggacgcgtttattctcttaaattatccatttgatagcctggaagcacaagatctaaataagaagatct
tcgaaaccatttattacggtgcattagaggcgagttgtgaactagctgagaaggaaggaccatacgatacatatgtaggatcgtacgccagtaacggt
attctacaatatgatctttggaatgttgtaccgtcggatctttggaattgggaacctctaaaagataaaatcagaacatacggtcttagaaatagtttatt
ggtggcacctatgccgactgcatcaactgctcaaattttgggaaataatgagtcggtggaaccgtataccagtaatatttacactcggagagtattgtct
ggagaatttcaagtagttaatccgcatctccttagagttttaaccgagagaaaattatggaatgatgagatcaagaataggattatggcagatggtgg
atccattcagaatacaaaaccttccagaagatattaagcgagtttataaaactatttgggaaattccacaaaagacgatcataaaaatggctgcagaca
ggggagccttcatcgatcaaagtcaatctatgaatatccatatagcagatccgagttattccaaactaacgagtatgcatttttacggatggagtctcg
gtctaaaaacgggaatgtactatctacgtacgaaacccgcatccgctcccattcaattcacattggacaaggataaaataaaaccaccggtggtttgt
gattccgaaatctgtacatcatgcagtggttaa >Gene117:58996..59178, 183 bp atggatattcatagattgactttgatcgatgaaggctcccctgtctgcagccatttttatgatcgtcttttgtggaatttcccaaatagtttttataaaactcgc
ttaatatcttctggaaggtttgtattctgaatggatccaccatctgccataatcctattcttgatctcatcattccataa >Gene118:59632..59865, 234 bp atgtctcttattagagatttcagcttctggaataggataataattaatatctataattttattgagatttctgacaattactttgaccacatccttcagtttg
agaaaatcaaatcgcccatctattacaaacatgttcaaggcaacagatgccagattacaaacggctacctcattagcatccgcatattgtattatctca
gtgcaaagattactacacttgatagttcctaa >Gene119:60154..60318, 165 bp atgttcctcgtttcctgtattcttttttaagatcgaggaacgccataatatcagaatgccacggttccaagtatatggccataactccaggccgtttgtttcc
tccctgatctatgtatctagcggtgttattataaactctcaacattggaataataccgtttga >Gene120:61149..61388, 240 bp atggtggatgctataaccgttctaactgcgataggcataactgtattaatgcttttgatggtaatttctggtgccgccctgatagtcaaggagttaaatcc
taatgatatattcactatgcaatcattaaagtttaatcgagccgtaacgattttcaaatatataggactctttatctatataccaggaacaatcattttgta
cgctacgtacgtcaaatccctattaatgaaaagttaa >Gene121:61407..62555, 1149 bp atgaataactttgttaaacaagtagcttcaaagtctctaaaacctaccaaaaaattgtctccgtcagatgaggtgatatctttaaacgaatgcataatat
cctttaacttggataactttattattgcaacgatgtactgtttactaagcccattaatactccggaggatgttctcaaatcactcttgatcatggaatcat
tcgcgtacgagaagatgataatcaaaggattaataaaaaatactaatatttagagcatatattaatgatatttattttactccattcggttggttgacggg
cgtcgacgatgatcctgaaacacacgtggtgataaaaataattttcaattcatcactaatatctatcaagtctcaagttatagaatatttaaaaccatac

FIG. 13W aatgtcaataacctatcggtacttaccacagaaaaagaattaagtattaatacgttcaatgttccggattctatacctatgtcgataatttcgtttttccc
attcgatacagattttatactagttattttgttttttggagtatataatgactcgtattgtggaataagctatataagtccgaaagagagactaccgtatat
catcgaaatattaaaaccgttggtgtcggaaattaacatgttatcggatgaaataggtagaacatcatccattagaatcttcaattccactagcgtcaa
aaaatttcctactaatacattaacatccatttgtgaaattgtttattcgtttgacgaatcatcctttccgacgcccaagacgttcactcctctaaacgcgag
tccatacattcctaaaaagatagtttcactattggatttaccatctaatgtggaaataaaggcgatatctagaggcggtgtggatttcatcactcatatta
ataataagcgtctaaacacaatcttggtaatagcaaaagataacttttaaaaaattctacattttctggaactttttatcaaagagaatattatttggaa
gggtatctacttatagaataatcaagtctagttttccagttcctactattaagtcggttactaataaaaaaaaaatatgtaagaaacattgttttgtca
attctcaatatacaactaggactttgtcacatattctttga >Gene122:61660..61809, 150 bp atgaaatccacaccgcctctagatatcgcctttatttccacattagatggtaaatccaatagtgaaactatctttttaggaatgtatggactcgcgtttag
aggagtgaacgtcttgggcgtcggaaaggatgattcgtcaaacgaataa >Gene123:61822..61983, 162 bp atggatgttaatgtattagtaggaaatttttttgacgctagtggaattgaagattctaatggatgatgttctacctatttcatccgataacatgttaatttcc
gacaccaacggttttaatatttcgatgatatacggtagtctctctttcggacttatatag >Gene124:62548..63819, 1272 bp atggaaagatatacagatttagtaattagtaaaataccagaactaggatttaccaatttattatgtcatatatattcactagctggattatgtagcaata
tagatgtatctaaatttttaacaaattgtaacggatatgtagtggagaaatatgatataatctacaaccgctggcaaagtgtcttgtattcctatcggtat
gatgttggaactagtagagttggggcacctgagcagacccaatagtagcgacgaactcgatcaaaagaaagagttaaccgacgagttaaagacgcg
ttaccattctatatatgatgtctttgagttacctactagtataccgttagcgtatttctttaaacctcgactacgggaaaaagtatctaaggcgatagactt
ctcacaaatggatttgaaaatcgatgatttatcacgtaaaggaatacatactggtgaaaatccaaaggtcgtcaagatgaaaatagagcctgagaga
ggagcctggatgagcaatcgaagtattaagaacttagtctctcagtttgcttatggatccgaagtggattatataggacaatttgacatgagagattcttaa
actccttagcgattcatgaaaaatttgacgcgtttatgaataaacatatcttatcgtatatacttaaagacaaaattaaaagttctacctctagatttgta
atgtttggattttgttatttgtctcattggaaatgtgtaatttatgataaaaaacaatgtttagtatcctttttatgactccggaggcaatattccaactgaat
tccaccactataataattttatttctattccttctccgatggttttaacacgaatcacagacattctgtattggataatacaaattgtgacatcgatgtttt
attcagattttttcgaatgtacatttggagcgaaaataggctgtattaatgtagaagttaatcagctgttggaatctgaatgtggaatgtttattagtttgtt
tatgatattgtgtactaggacaccacctaagagtttcaaatctctgaaaaaggtttatacattctttaaatttttagcggataagaaaatgacattattta
agagcattctatttaacctgcacgatctatcactggatataacggaaacggataacgcaggattaaaagaatataaacgtatggaaaagtggaccaa
aaagtcaattaatgtgatatgtgataaattaactacaaaattaaatagaatagtaaacgacgatgaataa >Gene125:63825..65855, 2031 bp atggaaaagaatttaccagatatcttcttttttccaaactgcgttaatgtattctcttacaaatattcacaagatgaattcagtaatatgagtaaaacgga
acgtgatagtttctcattggccgtgtttccagttataaaacatagatggcataacgcacacgttgtaaaacataaaggaatatacaaagttagtacaga
agcacgtggaaaaaaagtatctcctccatcactaggaaaaacccgcacacataaacctaaccgcgaagcaatatatatacagtgaacacacaataag
ctttgaatgttatagttttctaaaatgtataacaaatacagaaatcaattcgttcgatgagtatatattaagaggactattagaagctggtaatagtttac
agatatttccaattccgtaggtaaacgaacagatactataggtgtactagggaataagtatccatttagcaaaattccattggcctcattaactcctaa
agcacaacgagagatattttcagcgtggatttctcatagacctgtagttttaactggaggaactggagtgggtaagacgtcacaggtacccaagttatt
gctttggtttaattatttatttggtggattctctactctagataaaatcactaactttcacgaaagaccagtcattctatctcttcctaggatagctttagtt
agattgcatagcaataccatttttaaaatcattgggatttaaggtactagatggatctcctatttctttacggtacggatctataccggaagaattaataa
acaaacaaccaaaaaaatatggaattgtattttctacccataagttatctctaacaaaactatttagttatggcactcttattatagacgaagttcatga
gcatgatcaaataggagatattattatagcagtagcgagaaagcatcatacgaaaatagattctatgttttaatgactgccacgttagaggatgacc
gagaacggctaaaagtattttacctaatcccgcatttatacatattcctggagatacactgtttaaaattagcgaggtatttattcataataagataaat

FIG. 13X ccatcttccagaatggcatacatagaagaagaaaagagaaatttagttactgctatacagatgtatactcctcctgatggatcatccggtatagtctttg
tggcatccgttgcacagtgtcacgaatatataatcatatttagaaaaaagattaccgtatgatatgtatattattcatggtaaggtcttagatatagacga
aatattagaaaaagtgtattcatcacctaatgtatcgataattatttctactccttatttggaatccagcgttactatacgcaatgttacacacatttatga
tatgggtaaagtttttgtccccgctcctttggaggatcgcaagaatttatttctaaatctatgagagatcaacgaaaaggaagagtaggaagagttaa
tcctggtacatacgtctatttctatgatctgtcttatatgaagtctatacagcgaatagattcagaatttctacataattatatattgtacgctaataagttt
aatctaacactccccgaagatttgtttataatccctacaaatttggatattctatggcgtacaaaggaatatatagactcgttcgatattagtacagaaa
catggaataaattattatccaattattatatgaagatgatagagtatgctaaactttatgtactaagtcctattctcgctgaggagttggataactttgag
aggacgggagaattaactagtattgtacgagaagccattttatctctaaatttacgaattaagattttaaattttaaacataaagatgatgatacgtata
tacacttttgtaaaatattattcggtgtctataacggaacaaacgctactatatattatcatagacctctaacgggatatatgaatatgatttcagatact
atatttgttcctgtagataataactaa >Gene126:63881..64075, 195 bp atgtgtgcgggtttcctagtgatggaggagatactttttttccacgtgcttctgtactaactttgtatattcctttatgtttacaacgtgtgcgttatgcca
tctatgtttataactggaaacacggccaatgagaaactatcacgttccgtttactcatattactgaattcatcttgtgaatatttgtaa >Gene127:65859..67634, 1776 bp atgattgtcttaccgaataaagttcgtattttcatcaacgatcggatgaaaaaggatatctacttgggaatttctaatttcggattcgagaatgatatag
atgaaatcttgggaattgctcacttgttggaacatctacttatatcctttgattctactaatttttagcgaatgcttctacatctagaagttatatgagttttt
tggtgtaaatccattaattcagcaacggaatcggacgcaatcagaacattagtttcgtggttcttttctaacggaaaactcaaagataattttttcccttt c
tagtatacgatttcacattaaagaattagaaaacgaatactattttagaaatgaagtattccattgtatggatatactaacgtttcttagcggaggcgat
ttatataacggtgggagaatagacatgatagataatcttaatatagttcgtgatatgctggtaaatagaatgcaaaggatatcgggatcgaatatcgta
attttgttaagagattaggacctggaacattggatttcttcaaacagacatttgggtctttaccagcatgtccggagattattccttcgtctattccagta
agtacaaacggtaaaatagttatgactccgtctccatttatacagttatggtaaagattaatccaacattagataatatttagggattctgtatttgta
cgaaacttaccacttaatagactatgagactatcggcaaccagttatatttaacggtatcctttatcgatgaaactgaatacgagagctttcttcgtggc
gaggctatattacaaattagtcaatgtcaaagtattaatatgaattatagcgacgattatatgatgaacatctatttgaattttccttggctatcgcatga
tttatatgattacattacacgtattaatgacgatagcaagtcgatactaatatccttgacaaatgaaatatatgcatctataattaatagagatatcata
gttatttacccaaactttagtaaggccatgtgtaacactagagatacccaacaacatccgatagtagttcttgacgcaacaaatgatggactaattaag
aaaccttatagaagtatacccctaatgaagcgtctaacatctaatgaaatatttatacgatacggagacgcgtctctcatggacatgataactttatcat
tgtctaaacaagatatatcattaaaaagaaatgccgaaggaatacgtgtaaaacatagttttttcagctgatgatatacaggcaattatggaatctgatt
cgttttaaagtatagtagatcaaaaccagctgcgatgtatcaatatatatttctatcatttttttgctagtggtaattccatagatgacatattggcaaata
gagattctaccttagaattttctaaaagaactaaaagtaaaattttgtttggtaggaataccaggtacgacgtcactgcaaaatctagttttgtatgtgg
tatagtacgaggtaaatcattggataaaacgtctctggttgaaatgatgtgggatctcaagaagaaaggattaatatattctatggaatttaccaatct
attgagcaagaataccttttatctgttcacatttactatctacactgatgaagtatacgattatctaaacactaataaactttttctgcaaaatgtttagt
cgtgtctacaaaaggagatgtggaaaattttcatctctaaaaaaagatgtggtcattagagtttga >Gene128:67631..67966, 336 bp atggcatctttattatatcttattttatttttgttattcgtatgtatttcttattattttacatattatccgaccaataaacttcaggcagctgtaatggaaaca
gatagagaaaacgctattattagacagcgaaatgatgaaataccgactagaacattagatacagctatatttaccgatgcatcaaccgtcgcgagtgc
gcaaatacacctatattataattccaatattggtaaaattataatgtcacttaatggtaaaaaacacacctttaatttatacgatgataacgacatacga
acattacttcctattttactccttagtaaatga >Gene129:67960..68622, 663 bp atgccatttagagatctaattttgtttaacttgtccaaattcctacttacagaagatgaggaatcgttggagatagtgtcttccttatgtagaggatttga
aatatcttatgatgacttgataacttactttccagataggaaataccataaatatatttctaaagtatttgaacatgtagatttatcggaggaattaagta

FIG. 13Y tggaattccatgatacaactctgagagatttagtctatcttagattgtacaagtattccaagtgtatacggccgtgttataaattaggagataatctaaa
aggcatagttgttataaaggacaggaatatttatattagagaagcaaatgatgacttgatagaatatctcctcaaggaatacactcctcagatttatac
atattctaatgagcgcgtccccataactggttcaaaattaattctttgtggattttctcaagttacatttatggcgtatacaacgtcgcatataacaacaa
ataaaaaggtagatgttctcgtttccaaaaaatgtatagatgaactagtcgatccaataaattatcaaatacttcaaaatttatttgataaaggaagcg
gaacaataaacaaaatactcaggaagatattttattcggtaaccggtggccaaactccataa >Gene130:68592..68966, 375 bp atgaagaacgtactgattattttcggtaaaccgtattgtagtatttgtgaaaatgtcagtgatgcagtagaagaattaaaatccgagtatgatatactcc
atgttgatatcttatcattttttttaaaggatggtgattcaagtatgctgggtgacgtaaagcgcggaaccctaataggaaactttgcagcgcatctatct
aactacatcgtttccattttcaaatacaatccacagacaaaacaaatggcatttgtggacattaataaatccttggatttcaccaaaaccgataaatcg
ctggtgaatttggaaattctaaaatccgaaatagaaaaagcaaattatggagtttggccaccggttaccgaataa >Gene131:68969..70273, 1305 bp atgggtatcaaaaacttaaaatcgttactgctggaaaataaatcactgacgatattagatgataatttatacaaagtatacaatggaatatttgtggat
acaatgagtatttatatagccgtcgccaattgtgtcagaaacttagaagagttaactacggtattcataaaatacgtaaacggatgggtaaaaaaggg
agggcatgtaacccttttatcgatagaggaagtataaaaattaaacaagacgttagagacaagagacgtaaatattctaaattaaccaaggacaga
aaaatgctagaattagaaaagtgtacatccgaaatacaaaatgttaccggatttatggaagaagaaataaaggcagaaatgcaattaaaaatcgat
aaactcacatttcaaatatatttatctgattctgataacataaaaaatatcattgaatgagatactaacacatttcaacaataatgagaatgttacattatt
ttattgtgatgaacgagacgcagaattcgttatgtgtctcgaggctaaaacacatttctctaccacaggagaatggccgttgataataagtaccgatca
ggatactatgctatttgcatctactgataatcatcctaagatgataaaaaacttaactcaactgtttaaatttgttccctcggcagaggataactatttag
caaaattaacggcgttagtgaatggatgtgatttctttcctggactctatggggcatctataacacccaccaacttaaacaaaatacaattgtttagtga
ttttacaatcgataatatagtcactagtttggcaattaaaaattattatagaaagactaactctaccgtagacgtgcgtaatattgttacgtttataaacg
attacgctaatttagacgatgtctactcgtatgttcctccttgtcaatgcactgttcaagaatttatattttccgcattagatgaaaaatggaacaatttta
aatcatcttatttagagaccgttccgttaccctgccaattaatgtatgcattagaaccacgcaaggagattgatgtttcagaagttaaaactttatcatct
tatatagatttcgaaaatactaaatcagatatcgatgttataaaatctatatcttcgatcttcggatattctaacgaaaactgtaacactatagtgttcgg
catctataaggataatttactactgagtataaatagttcattttactttaacgatagtctgttaataaccaatactaaaagtgataatataataaatatag
gttactag >Gene132:70281..70472, 192 bp atggtgttccaactcgtgtgctctacatgcggcaaagatatttctcacgaacgatataaattgattatacgaaaaaaatcattaaaggatgtactcgtc
agtgtaaagaacgaatgttgtaggttaaaattatctacacaaatagaacctcaacgtaacttaacagtgcaacctctattggatataaactaa >Gene133:70474..70971, 498 bp atggatccggttaatttatcaagacatatgcgcctagaggttctattatttttattaattataccatgtcattaacaagtcatttgaatccatcgatagaa
aaacatgtgggtatttattatggtacgttattatcggaacacttggtagttgaatctacctatagaaaaggagttcgaatagtcccattggatagtttttt
gaaggatatcttagtgcaaaagtatacatgttagagaatattcaagttatgaaaatagcagctgatacgtcattaactttattgggtattccgtatggat
ttggtcatgatagaatgtattgttttaaattggtagctgaatgttataaaaatgccggtattgatacatcgtctaaacgaatattaggtaaagatattttt
ctgagccaaaacttcacagatgataatagatggataaagatatatgattctaataatttaacattttggcaaattgattaccttaaagggtga >Gene134:70936..72051, 1116 bp atggctgcagaacagcgtcgttctacaattttttgacatagtttcaaaatgtatagtgcaatctgtattaagagatatatctattaattctgaatacataga
gtccaaagctaaacaattgtgctattgtccggcatcgaaaaaggaatcggtgattaatggtatctacaattgttgcgagtcaaatatagaaataatgg
acaaagagcagctattaaaaatattggacaatcttcgatgtcattcggctcatgtatgtaacgccacagatttctggagactatataattcgttaaaac
ggtttactcatactaccgcattctttaatacatgcaagcccactattctagccacgctaaacactttgataaccctgatttatctaacaagttattgtatg

FIG. 13Z cggcagaaatggtagagtatctagagaaccaactagattcatcaaataaatcaatgtctcaagaactagcagaattattggaaatgaaatatgctctc
attaatctggtacaatataggattttgccaatgatcatcggtgagcctattatagtagctggattttctggtaaagaaccaatttctgattattctgcaga
agtggaaaggctaatggaactaccagttaaaactgatatagtgaataccacatatgacttcttagccagaaaaggtattgatactagcaacaatatag
cagaatatatagccggcttgaaaatagaagagattgaaaaggtagaaaaatatttaccagaagttatatctacaattgccaatagtaatataataaa
aaataaaaaatctatctttccggccaatatcaacgataaacagatcatggaatgctctagaatgttagacacgagtgagaaatactctaaaggatata
aaactgatggagctgtgactagtccattgacgggaaataatacaattacaacatttataccaatttctgcgtccgatatgcaaaagtttaccattttaga
atatctttacattatgagagtgatggcaaacaacgttaagaaaaagaacgagggaaaaaacaacggaggagtagttatgcatattaactcacccttt
aaggtaatcaatttgccaaaatgttaa >Gene135:71066..71464, 399 bp atggtaaacttttgcatatcggacgcagaaattggtataaatgttgtaattgtattatttcccgtcaatggactagtcacagctccatcagttttatatcct
ttagagtatttctcactcgtgtctaacattctagagcattccatgatctgtttatcgttgatattggccggaaagatagattttttattttttattatattact
attggcaattgtagatataacttctggtaaatattttttacctttttcaatctcttctattttcaagccggctatatattctgctatattgttgctagtatcaat
acctttttctggctaagaagtcatatgtggtattcactatatcagttttaactggtagttccattagcctttccacttctgcagaataa >Gene136:72012..72230, 219 bp atggcccaaatgtttacagatccgcccaaggcggcaaaaatatacattaactcatccgtcgagtctacatttatagatacttcttcactgaactctgaaa
aatatgccacaatttggcgcagtttatcgattttttatacggatgctcattttaaattttttgtaaattatttaaagttaaatggctgcagaacagcgtcgttc
tacaattttttgacatag >Gene137:72082..72864, 783 bp atgagcatccgtataaaaatcgataaactgcgccaaattgtggcatattttcagagttcagtgaagaagtatctataaatgtagactcgacggatgag
ttaatgtatattttttgccgccttgggcggatctgtaaacatttgggccattatacctctcagtgcatcagtgttctaccgcggagccgaaaacattgtgttt
aatcttcctgtgtccaaggtaaaatcgtgtttgtgtagttttcacaatgatgccatcatagatatagaacctgatctggaaaataatctagtaaaactttc
tagttatcatgtagtaagtgtcgattgtaacaaggaactgatgcctattaggacagatactactatttgtctaagtatagatcaaaagaaatcttacgtg
tttaattttcacaagtatgaagaaaaatgttgtggtagaaccgtcattcatttagaatggttgttgggctttatcaagtgtattagtcagcatcagcatttg
gctattatgtttaaagatgacaatattattatgaagactcctggtaatactgatgcgtttttccagggaatattctatgactgaatgttctcaagaactaca
aaagtttctttcaaaatagctatctcgtctctcaacaaactacgaggattcaaaaagagagtcaatgttttttgaaactagaatcgtaatggataatga
cgataacattctaggaatgttgtttttcggatagagttcaatcctttaagatcaacatctttatgacgttttttagattaa >Gene138:72884..73906, 1023 bp atgggtggcggagtaagtgttgagctccctaaacgggatccgcctccgggagtacccactgatgagatgttattaaacgtggataaaatgcatgacgt
gatagctcccgctaagcttttagaatatgtgcatataggaccactagcaaaagataaagaggataaagtaaagaaaagatatccagagtttagatta
gtcaacacaggacccggtggtctttcggcattgttaagacaatcgtataatggaaccgcacccaattgctgtcgcacttttaatcgtactcattattgga
agaaggatggaaagatatcagataagtatgaagagggtgcagtattagaatcgtgttggccagacgttcacgacaccggaaaatgcgatgttgattt
attcgactggtgtcaggggggatacgttcgatagaaacatatgccatcagtggatcggttcagcctttaataggagtaatagaactgtagagggtcaac
aatcgttaataaatctgtataataagatgcaaacattatgtagtaaagatgctagtgtaccaatatgtgaatcattttttgcatcatttacgcgcacacaa
tacagaagatagcaaagagatgatcgattatattctaagacaacagtctgcggactttaaacagaaatatatgagatgtagttatcccactagagata
agttagaagagtcattaaaatatgcggaacctcgagaatgttgggatccagagtgttcgaatgccaatgttaatttcttgctaacacgtaattataata
atttaggactttgcaatattgtacgatgtaatactagcgtgaacaacttacagatggataaaaacttcctcattaagattgtcatgtggattaagcaatag
tgatagatttctactgttcccgtcaatagagcaaaagtagttcaacataatattaaacactcgttcgacctaaaattgcatttgatcagtttattatctct
cttggtaatatggatactaattgtagctatttaa

FIG. 13AA

>Gene139:73907..74659, 753 bp atgggtgccgcggcaagcatacagacgacggtgaatacactcagcgaacgtatctcgtctaaattagaacaagaagcgaatgctagtgctcaaaca
aaatgtgatatagaaatcggaaatttttatatccgacaaaaccatggatgtaacctcactgttaaaaatatgtgctctgcggacgcggatgctcagttg
gatgctgtgttatcagccgctacagaaacatatagtggattaacaccggaacaaaaagcatacgtgccagctatgtttactgctgcgttaaacattcag
acgagtgtaaacactgttgttagagattttgaaaattatgtgaaacagacttgtaattctagcgcggtcgtcgataacaaattaaagatacaaaacgta
atcatagatgaatgttacggagccccaggatctccaacaaatttggaatttattaatacaggatctagcaaaggaaattgtgccattaaggcgttgatg
caattgacgactaaggccactactcaaatagcacctaaacaagttgctggtacaggagttcagttttatatgattgttatcggtgttataatattggcag
cgttgtttatgtactatgccaagcgtatgttgttcacatccaccaatgataaaatcaaacttattttagccaataaggaaaacgtccattggactacttac
atggacacattctttagaacttctccgatggttattgctaccacggatatgcaaaactga >Gene140:74691..74954, 264 bp atggaagttatcactgatcgtctagacgatatagtgaaacaaaatatagcggatgaaaaatttgtagattttgttatacacggtctagagcatcaatgt
cctgctatacttcgaccattaattaggttgtttattgatatactattatttgttatagtaatttatattttttacggtacgtctagtaagtagaaattatcaaat
gttgttggcgttggtggcgctagtcatcacattaactattttttattactttatactataa >Gene141:74944..75996, 1053 bp atgaatacccgtaccgatgttacaaacgataatatagacaaaaatccaaccaaacgaggtgataaaaatataccaggaagaaatgaaagatttaat
gaccaaaatagattcaacaacgatataccaaagcctaaaccaagactacagcctaatcagccaccgaaacaagataataaatgcagagaagagaa
tggagattttatcaatattagattgtgtgcctacgagaaggaatattgcaatgacggatatctatctcctgcctattatatgttaaaacaggtggatgat
gaagaaatgagttgctggtcagaactatcgtcgttggtgagatccagaaaggcggtgggatttcctctattaaaggcggctaaacgtatttctcacgga
tctatgctatattttgaacagttcaaaaacagtaaagttgtgagattaaccccgcaagttaaatgtttaaatgatactgttattttttcaaactgtagttatt
ttatattcaatgtataaacgtggcatatattctaacgaattttgtttgatctggtttctattcccagaacgaacattgttttttctgttaatcaattaatgttt
aacatttgtacagacatattggtagttctatctatttgcggcaaccggctctatagaacaaatctaccacagtcgtgttacttaaatttcatacacggcca
tgagacaatagcccgtagaggatatgaacactccaattacttttttcgagtggttgataaaaaatcacatatcgctattgaccaagcaaacgatggatat
tctcaaggtaaagaaaaagtatgctataggagcaccagtaaataggttgttagaacctggtacactggtatatgtgcccaaagaagattattactttat
aggcatatcactcaccgatgtgtcaattagcgataatgtcagagtattattttccacagatggaatagtgttagaaatagaagactttaatatcaagca
tttatttatggcaggtgagatgtttgttagaagtcagtctagtactattatagtataa >Gene142:76021..76776, 756 bp atgagtctactgctagaaaacctcatcgaagaagataccatattttttgcaggaagtatatctgagtatgatgatttacaaatggttattgccggcgcaa
aatccaaatttccaagatctatgctttctattttaatatagtacctagaacgatgtcaaaatatgagttggagttgattcataacgaaaatatcacagg
agcaatgtttaccacaatgtataatataagaaacaatttgggtctaggagatgataaactaactattgaagccattgaaaactatttcttggatcctaa
caatgaagttatgcctcttattattaataatacggatatgactgccgtcattcctaaaaaaagtggtaggagaaagaataagaacatggttatcttccg
tcaaggatcatcacctatcttgtgtattttcgaaactcgtaaaaagattaatatttataaagaaaatatggaatccgcgtcgactgagtatacacctatc
ggagacaacaaggctttgatatctaaatatgcgggaattaatgtcctgaatgtgtattctccttccacatccatgagattgaatgccatttacggattca
ccaataaaaataaactagagaaacttagtactaataaggaactagaatcgtatagttctagccctcttcaagaacccattaggttaaatgattttctgg
gactattggaatgtgttaaaaagaatattcctctaacagatattccgacaaaggattga >Gene143:76786..77172, 387 bp atggagaatgttcctaatgtatactttaatcctgtgtttatagagcccacgtttaaacattctttattaagtgtttataaacacagattaatagtttttatttg
aagtattcgttgtattcattctaatatatgtattttttagatctgaattaaatatgttctttatgcctaaacgaaaaatacccgatcctattgatagattacg
acgtgctaatctagcgtgtgaagacgataaattaatgatctatggattaccatggatgacaactcaaacatctgcgttatcaataaatagtaaaccgat
agtgtataaagattgtgcaaagcttttgcgatcaataaatggatcacaaccagtatctcttaacgatgttcttcgcagatga

FIG. 13AB

>Gene144:77055..77180, 126 bp atgaatcatcatctgcgaagaacatcgttaagagatactggttgtgatccatttattgatcgcaaaagctttgcacaatctttatacactatcggtttact
atttattgataacgcagatgtttga >Gene145:77129..77590, 462 bp atggatcacaaccagtatctcttaacgatgttcttcgcagatgatgattcatttttaagtatttggctagtcaagatgatgaatcttcattatctgatatat
tgcaaatcactcaatatctagactttctgttattattattgatccaatcaaaaaataaattagaagccgtgggtcattgttatgaatctctttcagaggaa
tacagacaattgacaaaattcacagactttcaagattttaaaaaactgtttaacaaggtccctattgttacagatggaagggtcaaacttaataaagg
atatttgttcgactttgtgattagtttgatgcgattcaaaaaagaatcctctctagctaccaccgcaatagatcctattagatacatagatcctcgtcgtg
atatcgcattttctaacgtgatggatatattaaagtcgaataaagtgaacaataattaa >Gene146:77362..77517, 156 bp atgtatctaataggatctattgcggtggtagctagagaggattctttttttgaatcgcatcaaactaatcacaaagtcgaacaaatatcctttattaagttt
gacccttccatctgtaacaataggggaccttgttaaacagtttttttaaaatcttga >Gene147:78860..79861, 1002 bp atggatgttgtgtcgttagataaaccgtttatgtattttgaggaaattgataatgagttagattacgaaccagaaagtgcaaatgaggtcgcaaaaaaa
ctgccgtatcaaggacagttaaaactattactaggagaattattttttcttagtaagttacagcgacacggtatattagatggtgccaccgtagtgtata
taggatctgctcccggtacacatatacgttatttgagagatcatttctataatttaggagtgatcatcaaatggatgctaattgacggccgccatcatgat
cctattttaaatggattgcgtgatgtgactctagtgactcggttcgttgatgaggaatatctacgatccatcaaaaaacaactgcatccttctaagattat
tttaatttctgatgtgagatccaaacgaggaggaaatgaacctagtacggcggatttactaagtaattacgctctacaaaatgtcatgattagtatttta
aaccccgtggcgtctagtcttaaatggagatgcccgtttccagatcaatggatcaaggactttatatcccacacggtaataaaatgttacaaccttttg
ctccttcatattcagctgaaatgagattattaagtatttataccggtgagaacatgagactgactcgagttaccaaattagacgctgtaaattatgaaaa
aaagatgtactaccttaataagatcgtccgtaacaaagtagttgttaactttgattatcctaatcaggaatatgactattttcacatgtactttatgctga
ggaccgtgtactgcaataaaacatttcctactactaaagcaaaggtactatttctacaacaatctatatttcgtttcttaaatattccaacaacatcaact
gaaaaagttagtcatgaaccaatacaacgtaaaatatctagcaaaaattctatgtctaaaaacagaaatagcaagagatccgtacgcggtaataaat
ag >Gene148:79776..80333, 558 bp atgaaccaatacaacgtaaaatatctagcaaaaattctatgtctaaaaacagaaatagcaagagatccgtacgcggtaataaatagaaacgtgctac
tgagatatactaccgatatagagtataatgatttagttactttaataaccgttagacataaaattgattctatgaaaactgtgtttcaggtatttaacgaa
tcatccataaattatactccggttgatgatgattatggagaaccaatcattataacatcgtatcttcaaaaaggtcataacaagtttcctgtaaattttct
atacatagatgtggtaatatctgacttatttcctagctttgttagactagatactacagaaactaatatagttaatagtgtactacaaacaggtgatggt
aaaaagactcttcgtcttcccaaaatgttagagacggaaatagttgtcaagattctctatcgccctaatataccattaaaaattgttagattttttccgcaa
taacatggtaactggagtagagatagccgatagatctgttatttcagtcgctgattaa >Gene149:80415..80816, 402 bp atgacggacgaacaaatttatgcattctgtgatgctaacaaagacgatatacgatgtaaatgtatttatcctgataaaagcatagtacggataggaat
agatacaagattaccctattattgttggtacgagccatgtaaacgaagcgatgcgttgttaccagcctctttaaaaaaaaatataacaaaatgcaatgt
atcggattgtaccatttcattgggaaacgtttccattacagatagtaaattagatgtaaataatgtttgtgattccaaacgagtagctaccgagaatata
gctgtccgctatttaaatcaggaaattagataccctattatagatatcaaatggcttccgattggattactagcgttagctattttaatattagcatttttct
aa

FIG. 13AC

>Gene150:80923..84783, 3861 bp atggctgtaatctctaaggttacgtatagtctatatgatcaaaaagagattaatgctacagatattatcattagtcatgttaaaaatgacgacgatatcg gtaccgttaaagatggtagactaggtgctatggatggggcattatgtaaaacttgtgggaaaacggaattggaatgtttcggtcactggggtaaagta agtatttataaaactcatatagttaagcctgaatttatttcagaaattattcgtttactgaatcatatatgtattcactgcggattattgcgttcacgagaa ccgtattccgacgatattaacctaaaagagttatcgggacacgctcttaggagattaaaggataaaatattatccaagaaaaagtcatgttggaacag cgaatgtatgcaaccgtatcaaaaaattacttttttcaaagaaaaaggtttgtttcgtcaacaagttggatgatattaacgttcctaattctctcatctatc aaaagttaatttctattcatgaaaagttttggccattattagaaattcatcaatatccagctaacttattttatacagactactttcccatccctccgctgat tattagaccggctattagtttttggatagatagtatacccaaagaaaccaatgaattaacttacttattaggtatgatcgttaagaattgtaacttgaatg ctgatgaacaggttatccagaaggcggtaatagaatacgatgatattaaaattatttctaataacactaccagtatcaatttatcatatatcacatccgg caaaaataatatgattagaagttatatcgtcgcccggcgaaaagatcagaccgctagatctgtaattggtcccagtacatctatcaccgttaatgaggt aggaatgcccgcatatattagaaatacacttacagaaaagatatttgttaatgcctttacagtggataaagttaaacaactattagcgtcaaaccaagt taaattttactttaataaacgattaaaccaattaacaagaatacgccaaggaaagtttatcaaaaataaaatacatttattgcctggtgattgggtaga agtagctgttcaagaatatacaagtattattttttggaagacagccgtctctacatagatacaacgtcatcgcttcatctatcagagctaccgaaggaga tactatcaaaatatctcccggaattgccaactctcaaaatgctgatttcgacggggatgaggaatggatgatattagaacaaaatcctaaagctgtaat tgaacaaagtattcttatgtatccgacgacgttactcaaacacgatattcatggagcccccgtttatggatctattcaagatgaaatcgtagcagcgtat tcattgtttaggatacaagatctttgtttagatgaagtattgaacatcttggggaaatatggaagagagttcgatcctaaaggtaaatgtaaattcagcg gtaaagatatctatacttacttgataggtgaaaagattaattatccgggtctcttaaaggatggtgaaattattgcaaacgacgtagatagtaattttgt tgtggctatgaggcatctgtcattggctggactcttatccgatcataagtcgaacgtggaaggtatcaactttattatcaagtcatcttatgtttttaagag atatctatctatttacggttttggggtgacattcaaagatctgagaccaaattcgacgttcactaataaattggaggccatcaacgtagaaaaaataga acttatcaaagaagcatacgccaaatatctcaacgatgtaagagacgggaaaatagttccattatctaaagctttagaggcggactatgtggaatcca tgttatccaacttgacaaatcttaatatccgagagatagaagaacatatgagacaaacgctgatagatgatccagataataacctcctgaaaatggcc aaagcgggttataaagtaaatcctacagaactaatgtatattctaggtacgtatggacaacaaaggattgatggtgaaccagcagagactcgagtatt gggtagagtcttaccttactatcttccagactctaaggatccagaaggaagaggttacattcttaattctttaacaaaaggattaacgggttctcaatat tacttttcgatgctggttgcaagatctcaatctactgatatcgtctgtgaaacatcacgtaccggaacactggctagaaaaatcattaaaaagatggag gatatggtggtcgacggatacggacaagtagttataggtaatacgctcatcaagtacgccgccaattataccaaaattctaggctcagtatgtaaacct gtagatcttatctatccagatgagtccatgacttggtatttggaaattagtgctctgtggaataaaataaaacagggattcgtttactctcagaaacaga aacttgcaaagaagacattggcgccgtttaatttcctagtattcgtcaaacccaccactgaggataatgctattaaggttaaggatctgtacgatatgat tcataacgtcattgatgatgtgagagagaaatacttctttacggtatctaatatagattttatggagtatatattcttgacgcatcttaatccttctagaat tagaattacaaaagaaacggctatcactatctttgaaaagttctatgaaaaactcaattatactctaggtggtggaactcctattggaattatttctgca caggtattgtctgagaagtttacacaacaagccctgtccagttttcacactactgaaaaaagtggtgccgtcaaacaaaaacttggtttcaacgagttt aataacttgactaatttgagtaagaataagaccgaaattatcactctggtatccgatgatatctctaaacttcaatctgttaagattaatttcgaatttgt atgtttgggagaattaaatccagacatcactcttcgaaaagaaacagataggtatgtagtagatataaatagtcaatagattatacatcaagagagcag aaattaccgaattagtcgtcgaatatatgattgaacgatttatctcctttagcgtcattgtaaaggaatggggtatggaaacattcattgaggatgagg ataatattagatttactgtctacctaaatttcgttgaaccggaagaattgaatcttagtaagtttatgatggttcttccgggtgccgccaacaagggcaa gattagtaaattcaagattcctatctctgactatacgggatatgacgacttcaatcaaacaaaaaagctcaataagatgactgtagaactcatgaatct aaaagaattgggttctttcgatttggaaaacgtcaacgtgtatcctggagtatggaatacatacgatatcttcggtatcgaggccgctcgtgaatacttg tgcgaagccatgttaaacacctatggagaagggttcgattatctgtatcagccttgtgatcttctcgctagtttactatgtgctagttacgaaccagaatc agtgaataaattcaagttcggcgcagctagtactcttaagagagctacgttcggagacaataaagcattgttaaacgcggctcttcataaaaagtcag aacctattaacgataatagtagctgccacttttttagcaaggtccctaatataggaactggatattacaaatactttatcgacttgggtcttctcatgaga atggaaaggaaactatctgataagatatcttctcaaaagatcaaggaaatggaagaaacagaagacttttaa

FIG. 13AD

>Gene151:83886..84101, 216 bp atgaatgtttccataccccattcctttacaatgacgctaaaggagataaatcgttcaatcatatattcgacgactaattcggtaatttctgctctcttgatg
tataatctattgactattatatctactacatacctatctgtttcttttcgaagagtgatgtctggatttaattctcccaaacatacaaattcgaaattaatct
taacagattga >Gene152:84780..85295, 516 bp atggataagaaaagtttgtataaatacttactactacgttcaactggagatatgcacagagccaaatctcccactataatgacaagggtaaccaataa
tgtgtatttgggaaattataaaaatgctatggatgcaccatcatctgaagttaagttcaaatatgttttaaatttgacgatggataaatatacattaccta
actctaatattaatattattcatataccgttggtagatgatacaactaccgatattagtaaatattttgacgacgtaaccgccttttatctaaatgtgatc
aacgaaacgagcccgtgttggttcattgtgctgcgggagtaaatagaagcggggctatgattttggcatatctaatgtctaaaaataaggagtcattgc
ctatgctatattttttatacgtgtatcattctatgagggacttgagaggcgcatttgtggaaaatccatcgtttaaaagacagatcatagaaaaatatgtt
attgataagaattaa >Gene153:85309..85878, 570 bp atggataaaactactttatcggtaaacgcgtgtaatttagaatacgttagagaaaaaggctatagtaggcgtacaagcagccaaaacatcaacacttat
attctttgttattatattggcaattagtgcgctattactctggtttcagacgtctgataatccagtctttaatgaattaacgagatatatgcgaattaaaaa
tacggttaacgattggaaatcattaacggatagcaaaacaaaattagaaagtgatagaggtagacttctagccgctggtaaggatgatatattcgaat
tcaaatgtgtggatttcggcgcctattttatagctatgcgattggataagaaaacatatctgccgcaagctattaggcgaggtactggagacgcgtgga
tggttaaaaaggcggcaaaggtcgatccatctgctcaacaattttgtcagtatttgataaaacacaagtctaataatgttattacttgtggtaatgagat
gttaaatgaattaggttatagcggttatttatgtcaccgcattggtgttccgattttagtaatatggaatag >Gene154:85881..86855, 975 bp atggcggcggcgaaaactcctgttattgttgtgccagttattgatagacttccatcagaaacatttcctaatgttcatgagcatattaatgatcagaagtt
cgatgatgtaaaggacaacgaagttatgccagaaaaaagaaatgttgtggtagtcaaggatgatccagatcattacaaggattatgcgtttatacagt
ggactggaggaaacattagaaatgatgacaagtatactcacttcttttcagggttttgtaacactatgtgtacagaggaaacgaaaagaaatatcgct
agacatttagccctatgggattctaatttttttaccgagttagaaaataaaaaggtagaatatgtagttattgtagaaaacgataacgttattgaggata
ttacgtttcttcgtcccgtcttgaaggcaatgcatgacaaaaaaatagatatcctacagatgagagaaattattacaggcaataaagttaaaaccgag
cttgtaatggacaaaaatcatgccatattcacatatacaggagggtatgatgttagcttatcagcctatattattagagttactacggcgctgaacatcg
tagatgaaattatataagtctggaggtctatcatcgggattttattttgaaatagccagaattgaaaacgaaatgaagatcaataggcagatactggat
aatgccgccaaatatgtagaacacgatcccgacttgttgcagaacaccgtttcgaaaacatgaaaccgaattttttggtctagaataggaacggcagc
tactaaacgttatccaggagttatgtacgcgtttactactccactgatttcatttttggattgtttgatattaatgttataggtttgattgtaattttgtttat
tatgtttatgctcatctttaacgttaaatctaaactgttatggttccttacaggaacattcgttaccgcatttatctaa >Gene155:86856..89243, 2388 bp atggactctaaagagactattctaattgagatcattccaaaaataaaagcatatctactagacgcgaatataagtccaaaatcctacgatgactttatt
tcacgaaataaaaatattttcgttatcaacctttataacgtatcgactatcacagaagaagatatacgattgttatacactacgatagaacagaatatt
gacgcggatgatcaaacactggttgctatttttttcgtatataggatataaatttgaacaggctgttaaagaagagattagtacgagtttatccttcaatg
acaagaataccacagatgaaatgacgtataacttgtatgatctttttttttaacacattagacatgtatttacgacaaaagaagatcagtattctggtaaa
tgatgatgttagaggtgatgtaatcgttagttataaaaatagtgacttagtttcatcatttaatgcggaactagaaccagagattaagaagataccgttc
aatatgaaaaatctattaccgtacttggaaaagaatttggaccaattaagattctctaaaaaatatttagactttgcatatttatgtagacacatcggta
ttcccatttccaaaaaaaagtataatgtgcgatatgtatttctttataaaatagacggattatccattcctattatcattaaggattttttagatgttaagt
acgtatatttggaaaatactggaaaaatttataaaaaattcttttttccgaagaccataacaacagtctatctgattggggtaaagttattatacctctctta
aaggatcgtcatctatatagctacatctttctatctagttatcatttacatagttactatacagatctcatcgcgagagacgagcctgtgtttgtgaaacg

FIG. 13AE caaaaaactagatattatagagatcgatgaacctgaggcatggaaaagggatgttagagtggaattcgcaccgtgtgagcatcaaattagattgaag
gaagctatgaaagttgacgctaactatttcactaaaattaataattttgctaacgaatttatttattatgaagatggtgtggcatattgtagagtgtgtgg
aataaatatacctatatttaatttagatgccgctgacgtgattaaaaatacagttatcgtttccacgtttaacaagactatatttttgagcgaaccatata
gctatttcgttcatagtcagcgcttatctttaatattatcatgtcttttgataatattatgaaatctcaaacttgggtaatgaaatacaacattaaccgact
aattcttaactttcttattgatataaactctagacgtcaggaatacgaaaaaaagtttcttctgaaattaagagaggtctgttctttcttcgtttgtctgca
aacttattcgaaagtcaagtatcgtctacagagttattttatgtttccaaaatgcttaatttgaactatatagttgcgttagtaatcattcttaacagtagt
gcggactttatagtttcctatatgacatccaagaacaaaacggtagaagaatccactcttaaatacgccatctccgtggttatatacgatttttttggttaa
gactagaatttgcgagaagggatcgttggatactatagtttatttaccgatgtatacacatctataatgccggaggaattggatttacattttcagaga
atcacattagaacttagaaaactagtatccattcagagatcggcgttagaacccaattacgatgtagaaagtcgcggcgaagagcttccgctatctgc
attaaagtttttcgatacaagcaccattatagttaaaacaatggctccagtacatacatacatcgaacaaaaaattgttgcacctactccatcggtcga
accaactgatgcatctcttaaaaacttcaaagagctaacgtgtgacgaagatattaagattttgattagagttcatgatactaatgctacaaaattagt
cattttccatcacatctaaaaatagaaattgagagaaaaaaactaattataccgctaaagagtttatatattaccaatactctcaaatattattattcta
actcctatttatacgttttcagattcggagatcctatgccattcgaagaagaactcatagatcacgaacatgtgcaatacaaaataaattgttacaatat
tctaagatatcatttattgccagacagtgacgtgtttgtatattttagtaattcattaaacagagaagcattggaatacgcattttatatctttttgtcgaa
atatgtaaatgtgaaacaatggatagacgaaaatataactcgtattaaagagttgtatatgattaatttcaataactaa >Gene156:88639..88815, 177 bp atgggaataccgatgtgtctacataaatatgcaaagtctaaatattttttagagaatcttaattggtccaaattcttttccaagtacggtaatagattttc
atattgaacggtatcttcttaatctctggttctagttccgcattaaatgatgaaactaagtcactatttttataa >Gene157:89429..90040, 612 bp atggcgtggtcaattacgaataaagcggatactagtagcttcacaaagatggctgaaatcagagctcatctaaaaaatagcgctgaaaataaagata
aaaacgaggatattttcccggaagatgtaataattccatctactaagcccaaaaccaaacgagccactactcctcgtaaaccagcggctactaaaag
atcaaccaaaaaggaggaagtggaagaagaagtagttatagaggaatatcatcaaacaactgaaaaaaattctccatctcctggagtcagcgacat
tgtagaaagcgtggccgctgtagagctcgatgatagcgacggggatgatgaacctatggtacaagttgaagctggtaaagtaaatcatagtgctaga
agcgatctttctgacctaaaggtggctaccgacaatatcgttaaagatcttaagaaaattattactagaatctctgcagtatcgacggttctagaggatg
ttcaagcagctggtatctctagacaatttacttctatgactaaagctattacaacactatctgatctagtcaccgagggaaaatctaaagttgttcgtaa
aaaagttaaaacttgtaagaagtaa >Gene158:90041..90985, 945 bp atgcgtgcactttttttataaagatggtaaactctttaccgataataattttttaaatcctgtatcagacgataatccagcgtatgaggttttgcaacatgtt
aaaattcctactcatttaacagatgtagtagtatatgaacaaacgtgggaggaggcgttaactagattaattttttgtgggaagcgattcaaaaggacgt
agacaatacttttacggaaaaatgcatgtacagaatcgcaacgctaaaagagatcgtattttttgttagagtatataacgttatgaaacgaattaattgt
tttataaacaaaaatataaagaaatcgtccacagattccaattatcagttggcggtttttatgttaatggaaactatgttttttattagatttggtaaaat
gaaatatcttaaggagaatgaaacagtagggttattaacactaaaaaataaacacatagaaataagtcccgatgaaatagttatcaagtttgtagga
aaggacaaagtttcacatgaatttgttgttcataagtctaatagactatataaaccgctattgaaactgacggatgattctagtcccgaagaatttctgt
tcaacaaactaagtgaacgaaaggtatacgaatgtatcaaacagtttggtattagaatcaaggatctccgaacgtatggagtcaattatacgtttttat
ataattttggacaaatgtaaagtccatatctcctcttccatcaccaaaaaagttaatagcgttaactatcaaacaaactgctgaagtggtaggtcatac
tccatcaatttcaaaaagagcttacatggcaacgactatttttagaaatggtaaaggataaaaattttttagatgtagtatctaaaactacgttcgatga
attcctatctatagtcgtagatcacgttaaatcatctacggatggatga >Gene159:90958..91140, 183 bp atggtattgtttggatggcgtttaaatatagacattatcaatgccataatatctaatgtgcttagctccccaaagaaagcggtcattgcgagagatttca
tacgcttatccatttccatttatcggtcttgtaattatttgtgtaaagatctatatcatccatccgtagatgatttaacgtga

FIG. 13AF

>Gene160:91022..91462, 441 bp atggaaatggataagcgtatgaaatctctcgcaatgaccgctttctttggggagctaagcacattagatattatggcattgataatgtctatatttaaac
gccatccaaacaataccatttttcagtggataaggatggtcagtttatgattgatttcgaatacgataattataaggcttctcaatatttggatctgacc
ctcactccgatatttggagatgaatgcaagactcacgcatcgagtatagccgaacaattggcgtgtgcggatattattaaagaggatattagcgaata
catcaaaactactccccgtcttaaacgatttataaaaaaataccgcaatagatcagatactcgcatcagtcgagatacagaaaagcttaaaatagctc
tagctaaaggcatagattacgaatatataaaaagacgcttgttaa >Gene161:91506..94040, 2535 bp atggatgccaacatagtatcatcttctactattgcaacgtatatagacgctttagcgaagaatgcttcagaattagaacagaggtctaccgcatacgaa
ataaataatgaattggaactagtatttattaagccgccattaattactttgacaaatgtagtgaatatctctacgattcaggaatcgtttattcgatttac
cgttactaataaggaaggtgttaaaattagaactaagattccattatctaaggtacatggtctagatgtaaaaaatgtacagttagtagatgctataga
taacatagtttgggaaaagaaatcattagtgacggaaaatcgtcttcacaaagaatgcttgttgagactatcgacagaggaacgtcatatattttttgga
ttacaagaaatatggatcctctatccgactagaattagtcaatcttattcaagcaaaaacaaaaaactttacgatagactttaagctaaaatattttcta
ggatccggtgcccaatctaaaagttctttgttgcacgctattaatcatccaaagtcaaggcctaatacatctctggaaatagaattcacacctagagac
aatgaaaaagttccatatgatgaactaataaaggaattgacgactctatcacgtcatatatttatggcttctccagagaatgtaattctttctccgcctat
taacgcacctataaagactttttatgttgcctaaacaagatatagtaggtctggatctggaaaatctatatgccgtaactaagactgacggcattcctata
actatcagagttacatcaaacgggttgtattgttattttacacatcttggttatattattagatatcctgttaagagaataatagattccgaagtagtagtc
tttggtgaggcagttaaggataagaactggaccgtatatctcattaagctaatagagcctgtgaatgcaatcaatgatagactagaagaaagtaagta
tgttgaatctaaactagtggatatttgtgatcggatagtattcaagtcaaagaaatatgaaggtccgtttactacaactagtgaagtcgtcgatatgtta
tctacatatttaccaaagcaaccagaaggtgttattctgttctattcaaagggacctaaatctaacattgattttaaaattaaaaaggaaaatactatag
accaaactgcaaatgtagtatttaggtacatgtccagtgaaccaattatctttggagaatcgtctatctttgtagagtataagaaatttagcaacgataa
aggctttcctaaagaatatggttctggtaagattgtgttatataacggcgttaattatctaaataatatctattgtttggaatatattaatacacataatga
agtgggtattaagtccgtggttgtacctattaagtttatagcagaattcttagttaatggagaaatacttaaacctagaattgataaaaccatgaaatat
attaactcagaagattattatggaaatcaacataatatcatagttgaacatttaagagatcaaagcatcaaaataggagatatctttaacgaggataa
actatcggatgtgggacatcaatacgccaataatgatataaatttagattaaatccagaagttagttattttacgaataaacgaactagaggaccgttgg
gaattttatcaaactacgtcaagactcttcttatttctatgtattgttccaaaacattttagacgattccaacaaacgaaaggtattggcgattgattttg
gaaacggtgctgacctggaaaaatactttatggagagattgcgttattggtagcgacggatccggatgctgatgctatagctagaggaaatgaaaga
tacaacaaattaaactctggaattaaaaccaagtactacaaatttgactacattcaggaaactattcgatccgatacatttgtctctagtgtcagagaa
gtattctattttggaaagtttaatatcatcgactggcagtttgctatccattattcttttcatccgagacattatgctaccgtcatgaataacttatccgaac
taactgcttctggaggcaaggtattaatcactaccatggacggagacaaattatcaaaattaacagataaaaagactttttataattcataagaatttac
ctagtagcgaaaactatatgtctgtagaaaaaatagctgatgatagaatagtggtatataatccatcaacaatgtctactccaatgactgaatacatta
tcaaaaagaacgatatagtcagagtgtttaacgaatacggatttgttcttgtagataacgttgatttcgctacaattatagaacgaagtaaaaagtttat
taatggcgcatctacaatggaagatagaccgtctacaaaaaacttttttcgaactaaatagaggagccattaaatgtgaaggtttagatgtcgaagact
tacttagttactatgttgtttatgtctttttctaagcggtaa >Gene162:91859..91987, 129 bp atgcttgttgagactatcgacagaggaacgtcatatattttttggattacaagaaatatggatcctctatccgactagaattagtcaatcttattcaagca
aaaacaaaaaactttacgatagactttaa >Gene163:93411..93572, 162 bp atgtctcggatgaaaagaataatggatagcaaactgccagtcgatgatattaaactttccaaaatagaatacttctctgacactagagacaaatgtat
cggatcgaatagtttcctgaatgtagtcaaatttgtagtacttggttttaattccagagtttaa

FIG. 13AG

>Gene164:93716..93970, 255 bp atggctcctctatttagttcgaaaaagttttttgtagacggtctatcttccattgtagatgcgccattaataaactttttacttcgttctataattgtagcga
aatcaacgttatctacaagaacaaatccgtattcgttaaacactctgactatatcgttcttttttgataatgtattcagtcattggagtagacattgttgatg
gattatataccactattctatcatcagctatttttttctacagacatatag >Gene165:93999..94439, 441 bp atgtccatcaatatcgatataaaaaaaataactgatttactcaacagtagtattttattcccagatgatgtgcaagaacttcttcgagagaaatatatag
tattagaaagaaaatcaaatggtacacctacagtagctcacatctataagacaatggctagatttgataataagagtatatatagaatcgccaagtttt
tatttatgaacaggccagatgttatcaaactttattttttagaagacgtagaacctctgttacccgacaaaagtattaatatatcattaacaatacaga
gtatccacagttggaaggtcctataggaacaaaaatcgctctattggaattatttaatgcatttagaacggggatatcagaacccataccatattattat
ttaccgcttagaaaagacataaacaacatagtaactaagtaa >Gene166:94054..94296, 243 bp atgggttctgatatccccgttctaaatgcattaaataattccaatagagcgatttttgttcctataggaccttccaactgtggatactctgtattgttaata
gatatattaatactttttgtcgggtaacagaggttctacgtcttctaaaaataaaagtttgataacatctggcctgttcataaataaaaacttggcgattct
atatatactcttattatcaaatctagccattgtcttatag >Gene167:94432..95145, 714 bp atggacatttttatagttaaggataataagtatcccaaagtagataacgacgataacgaagtatttatacttttaggaaatcacaatgactttatcagat
caaaattaacaaaattaaaggagcatgtatttttttctgaatatattgtgactccagataaatatggatctttatgcgtcgaattaaatgggtctagtttt
cagcacggcggtagatatatagaggtggaggaatttatagatgctggaagacaagttagatggtgttctacatccaatcatatatctgaagatatacc
cgaagatatacacactgataaaatttgtcatttatgatatatacacttttgacgctttcaagaataaacgattggtattcgtacaggtacctccgtcgttag
gagatgatagctatttgactaatccgttattgtctccgtattatcgtaattcagtagccagacaaatggtcaatgatatgatttttaatcaagattcatttt
taaaatatttattagaacatctgattagaagccactatagagtttctaaacatataacaatagttagatacaaggataccgaagaattaaatctaacg
agaatatgttataatagagataagtttaaggcgtttgtattcgcttggtttaacggcgtttcggaaaatgaaaaggtactagatacgtataaaaaggta
tctaatttgatataa >Gene168:95145..95801, 657 bp atgaattcagtgactgtatcacacgcgccatatactattacttatcacgatgattgggaaccagtaatgagtcaattggtagagttttataacgaagtag
ccagttggctgctacgagacgagacgtcgcctattcctgataagttctttatacagttgaaacaaccgcttagaaataaacgagtatgtgtgtgcggtat
agatccgtatccgaaagatggaactggtgtaccgttcgaatcaccaaattttacaaaaaaatcaattaaggagatagcttcatctatatctagattaac
cggagtaattgattataaaggttataaccttaatataatagacggggttataccctggaattattacttaagttgtaaattaggagaaacaaaaagtca
cgcgatctactgggataagatttccaagttactgctgcagcatataactaaacacgttagtgttctttattgtttgggtaaaacagatttctcgaatatac
gggccaagttagaatccccggtaactaccatagtcggatatcatccagcggctagagaccgccaattcgagaaagatagatcatttgaaattatcaac
gttttactggaattagacaacaaggcacctataaattgggctcaagggtttatttattaa >Gene169:95829..96038, 210 bp atgaaaattctgactatagagtatgcttcctcatccctaagactttcgaatagtgtacattctggattattctcaatatatctttctaactcgtcgcatttaa
atgcttctacaaatcttggatcttcattttgtctgcacgctgacgggacacctatagtcttaagaacaaagataacatcattacctctaatagccgcatcc
atttag

FIG. 13AH

>Gene170:95833..98190, 2358 bp atggatgcggctattagaggtaatgatgttatctttgttcttaagactataggtgtcccgtcagcgtgcagacaaaatgaagatccaagatttgtagaa
gcatttaaatgcgacgagttagaaagatatattgagaataatccagaatgtacactattcgaaagtcttagggatgaggaagcatactctatagtcag
aattttcatggatgtagatttagacgcgtgtctagacgaaatagattatttaacggctattcaagattttattatcgaggtgtcaaactgtgtagctagat
tcgcgtttacagaatgcggcgccattcatgaaaatgtaataaaatccatgagatctaattttcattgactaagtctacaaatagagataaaacaagtt
ttcatattatctttttagacacgtataccactatggatacattgatagctatgaaacgaacactattagaattaagtagatcatctgaaaatccactaac
aagatcgatagacactgccgtatataggagaaaaacaactcttcgggttgtaggtactaggaaaaatccaaattgcgacactattcatgtaatgcaac
caccgcatgataatatagaagattacctattcacttacgtggatatgaacaacaatagttattacttttctctacaacaacgattggaggatttagttcct
gataagttatgggaaccagggtttatttcattcgaagacgctataaaaagagtttcaaaaatattcattaattctataataaactttaatgatctcgatg
aaaataattttacaacggtaccactggtcatagattacgtaacaccttgtgcattatgtaaaaaacgatcgcataaacatccgcatcaactatcgttgg
aaaatggtgctattagaatttacaaaactggtaatccacatagttgtaaagttaaaattgttccgttagatggtaataaactgtttaatattgcacaaag
aattttagacactaactctgttttattaaccgaacgaggagaccatatagtttggattaataattcatggaaatttaacagcgaagaacccttgataac
aaaactaattttgtcaataagacatcaactacctaaggaatattcaagcgaattactctgtccaagaaaacgaaagactgtagaagctaacatacga
gacatgttagtagattcagtagagaccgatacctatccggatataacttccgtttaaaaatggtgtattggacctggtagacggaatgtttactctggag
atgatgctaaaaaatatacgtgtactgtatcaaccggatttaaatttgacgatacaaagttcgtcgaagacagtccagaaatggaagagttaatgaat
atcattaacgatatccaaccattaacggatgaaaataagaaaaatagagagctatatgaaaaaacattatctagttgtttatgtggtgctaccaaagg
atgtttaacattctttttggagaaactgcaactggaaagtcgacaaccaaacgtttgttaaagtctgctatcggtgacctgtttgttgagacgggtcaa
acaattttaacagatgtattggataaaggacctaatccatttatcgctaacatgcatttgaaaagatctgtattctgtagcgaactacctgattttgcctg
tagtggatcaaagaaaattagatctgacaatattaaaaagttgacagaaccttgtgtcattggaagaccgtgtttctccaataaaattaataatagaa
accatgcgacaatcattatcgatactaattacaaacctgttttgataggatagataacgcattaatgagaagaattgccgtcgtgcgattcagaacac
acttttctcaaccttctggtagagaggctgctgaaaataatgacgcgtacgataaagtcaaactattagacgaggggttagatggtaaaatacaaat
aatagatatagattcgcatttctatacttgttggtgaaatggtacagaaaatatcatgttcctattatgaaactatatcctacaccggaagagattccgg
actttgcattctatctcaaaataggtactctgttagtatctagctctgtaaagcatattccattaatgacggacctctccaaaaagggatatatattgtac
gataatgtggtcactcttccgttgactactttccaacagaaaatatccaagtattttaattctagactatttggacacgatatagagagcttcatcaatag
acataagaaatttgccaatgttagtgatgaatatctgcaatatatattcatagaggatatttcatctccgtaa >Gene171:96489..96659, 171 bp atgaccagtggtaccgttgtaaaattattttcatcgagatcattaaagtttattatagaattaatgaatattttttgaaactctttttatagcgtcttcgaatg
aaataaaccctggttcccataacttatcaggaactaaatcctccaatcgttgttgtagagaaaagtaa >Gene172:97416..97634, 219 bp atgattgtcgcatggtttctattattaattttattggagaaacacggtcttccaatgacacaaggttctgtcaacttttttaatattgtcagatctaattttctt
tgatccactacaggcaaaatcaggtagttcgctacagaatacagatcttttcaaatgcatgttagcgataaatggattaggtcctttatccaatacatct
gttaaaattgtttga >Gene173:97926..98168, 243 bp atgaatatatattgcagatattcatcactaacattggcaaatttcttatgtctattgatgaagctctctatatcgtgtccaaatagtctagaattaaaatac
ttggatattttctgttggaaagtagtcaacggaagagtgaccacattatcgtacaatatatatcccttttggagaggtccgtcattaatggaatatgctt
tacagagctagatactaacagagtacctattttgagatag >Gene174:98231..100144, 1914 bp atgaataccggaatcatagatttatttgataatcatgttgatagtataccaactatattacctcatcagttagctactctagattatctagttagaactatc
atagatgagaacagaagcgtgttattgttccatattatgggatcaggtaaaacaataatcgctttgttgttcgccttggtagcttccagatttaaaaagg

FIG. 13AI tttacattctagtgcctaatatcaacattttgaaaatttttaattataatatgggtgtagctatgaacttgtttaatgacgaattcatagctgagaatatctt
tattcattccacaacaagttttattctcttaattataacgataacgtcattaattataacggattatctcgctacaataactctattttatcgttgatgag
gcacataatatctttgggaataatactggagaacttatgaccgtgataaaaaataaaaacaagattccttttctactattgtctggatctcccattacta
acacacctaatactctgggtcatattatagatttaatgtccgaagagacgatagattttggtgagattattagtcgtggtaagaaagtaattcagacact
tcttaacgaacgcggtgtgaatgtacttaaggatttgcttaaaggaagaatatcatattacgaaatgcctgataaagatctaccaacgataagatatca
cggacgtaagtttctagatactagagtagtatattgtcacatgtctaaacttcaagagagagattatatgattactagacgacagctatgttatcatgaa
atgtttgataaaaatatgtataacgtgtcaatggcagtattgggacaacttaatctgatgaataatttagatactttatttcaggaacaggataaggaat
tgtacccaaatctgaaaataaataatggcgtgttatacggagaagaattggtaacgttaaacattagttccaaatttaaatactttattaatcggatac
agacactcaacggaaaacattttatatactttctaattctacatatggtggattggtaattaaatatatcatgctcagtaatggatattctgaatataat
ggttctcagggaactaatccacatatgataaacggcaaaccaaaaacatttgctatcgttactagtaaaatgaaatcgtctttagaggatctattagat
gtgtataattctcctgaaaacgatgatggcagtcaattgatgttttttgttttcatcaaacattatgtccgaatcctatactctaaaagaggtaaggcatat
ttggtttatgactatcccagatactttttctcaatacaaccaaattcttggacgatctattagaaaattctcttacgccgatatttctgaaccagttaatgt
atatcttttagccgccgtatattccgatttcaatgacgaagtaacgtcattaaacgattacacacaggatgaattgattaatgtttttaccatttgacatca
aaaagctgttgtatctaaaatttaagacgaaagaaacgaatagaatatactctattcttcaagagatgtctgaaacgtattctcttccaccacatccatc
aattgtaaaagtttattgggagaattggtcagacaatttttttataataattctcgtattaagtataacgactccaagttacttaaaatggttacatcagt
tataaaaaataaagaagacgctaggaattacatagatgatattgtaaacggtcacttctttgtatcgaataaagtatttgataaatctcttttatacaaa
tacgaaaacgatattattacagtaccgtttagactttcctacgaaccatttgtttggggagttaactttcgtaaagaatataacgtggtatcttctccata
a >Gene175:99118..99309, 192 bp atgatatatttaattaccaatccaccatatgtagaattagaaaagtatataaaatgttttccgttgagtgtctgtatccgattaataaagtatttaaatttg
gaactaatgtttaacgttaccaattcttctccgtataacacgccattatttattttcagatttgggtacaattccttatcctgttcctga >Gene176:99194..99361, 168 bp atgtggattagttccctgagaaccattatattcagaatatccattactgagcatgatatatttaattaccaatccaccatatgtagaattagaaaagtat
ataaaatgttttccgttgagtgtctgtatccgattaataaagtatttaaatttggaactaatgtttaa >Gene177:100104..100238, 135 bp atgtctaacgtcagctcgtgtggttccaatgtaactggaaggtatccattggtaacaaagctcgacatttatttctttatatatttcatcagtttttatggag
aagataccacgttatattctttacgaaagttaa >Gene178:100171..100656, 486 bp atgtcgagctttgttaccaatggataccttccagttacattggaaccacacgagctgacgttagacataaaaactaatattaggaatgccgtatataag
acgtatctccatagagaaattagtggtaaaatggccaagaaaatagaaattcgtgaagacgtggaattacctctcggcgaaatagttaataattctgt
agttataaacgttccgtgtgtaataacctacgcgtattatcacgttggggatatagtcagaggaacattaaacatcgaagatgaatcaaatgtaactat
tcaatgtggagatttaatctgtaaactaagtagagattcgggtactgtatcatttagcgattcaaagtactgctttttttcgaaatggtaatgcgtatgaca
atggcagcgaagtcactgccgttctaatggaggctcaacaaggtatcgaatctagttttgtttttctcgcgaatatcgtcgactcataa >Gene179:100619..101533, 915 bp atgccgcaacaactatctcctattaatatagaaactaaaaaagcaatttctaacgcgcgattgaagccgttagacatacattataatgagtcgaaacc
aaccactatccagaacactggaaaactagtaaggattaattttaaaggaggatatataagtggagggtttctccccaatgaatatgtgttatcatcact
acatatatattggggaaaggaagacgattatggatccaatcacttgatagatgtgtacaaatactctggagagattaatcttgttcattggaataaaaa
aaaatatagttcttatgaagaggcaaaaaaacacgatgatggacttatcattatttctatattcttacaagtattggatcataaaaatgtatattttcaa
aagatagttaatcaattggattccattagatccgccaatacgtctgcaccgtttgattcagtattttatctagacaatttgctgcctagtaagttggattat

FIG. 13AJ tttacatatctaggaacaactatcaaccactctgcagacgctgtatggataattttttccaacgccaataaacattcattctgatcaactatctaaattcag
aacactattgtcgtcgtctaatcatgatggaaaaccgcattatataacagagaactatagaaatccgtataaattgaacgacgacacgcaagtatatt
attctggggagattatacgagcagcaactacctctccagcgcgcgagaactattttatgagatggttgtccgatttgagagagacatgtttttcatatta
tcaaaaatatatcgaagagaataaaacattcgcaattattgccatagtattcgtgtttatacttaccgctattctcttttttatgagtcgacgatattcgcg
agaaaaacaaaactag >Gene180:101131..101286, 156 bp atgtgtacaaatactctggagagattaatcttgttcattggaataaaaaaaaatatagttcttatgaagaggcaaaaaaacacgatgatggacttatc
attatttctatattcttacaagtattggatcataaaaatgtatattttcaaaagatag >Gene181:101575..102216, 642 bp atgggaattacaatggatgaggaagtgatatttgaaactcctagagaattaatatctattaaacgaataaaagatattccaagatcaaaagacacgc
atgtgtttgctgcgtgtataacaagtgacggatatccgttaataggagctagaagaacttcattcgcgttccaggcgatattatctcaacaaattcaga
ttctatctttagagtatccactaaactattacggtttatgtactacaatgaactaagagaaatctttagacggttgagaaaaggttctatcaacaatatc
gatcctcactttgaagagttaatattattgggtggtaaactagataaaaaggaatctattaaagattgtttaagaagagaattaaaagaggaaagtga
tgaacgtataacagtaaaagaatttggaaatgtaattctaaaacttacaacacgggataaattatttaataaagtatatataagttattgcatggcgtg
ttttattaatcaatcgttggaggatttatcgcatactagtatttacaatgtagaaattagaaagattaaatcattaaatgattgtattaacgacgataaat
acgaatatctgtcttatatttataatatgctagttaatagtaaatga >Gene182:102213..102959, 747 bp atgaacttttacagatctagtataattagtcagattattaagtataatagacgactagctaagtctattatttgcgaggatgactctcaaattattacact
cacggcattcgttaaccaatgcctatggtgtcataaacgagtatccgtgtccgctattttattaactactgataacaaaatattagtatgtaacagacga
gatagttttctctattctgaaataattagaactagaaacatgtctagaaagaaacgattatttctgaattattccaattatttgtccaaacaggaaagaa
gtatactatcgtcatttttttctctagatccagctactactgataatgatagaatagatgctatttatccgggtggcatacccaaaagggggtgagaatgtt
ccagagtgtttatccagggaaattaaagaagaagttaatatagacaattctttttgtattcatagacactcggtttttttattcatggcatcatagaagata
ccattattaataaattttttgaggtaatcttctttgtcggaagaatatctttaacgagtgatcaaatcattgatacatttaaaagtaatcatgaaatcaag
gatctaatattttttagatccgaattcaggtaatggactccaatacgaaattgcaaaatatgctctagatactgcaaaactcaaatgttatggccataga
ggatgttattacgaatcattaaaaaaaattaactgaggatgattga >Gene183:102960..104855, 1896 bp atgagtaaatcacacgcggcctatatcgattatgcattgcgcagaactactaatatgcccgttgaaatgatggggtcggacgtagtacgcctcaagga
ttatcaacattttgtagcaagagttttcttaggattagacagtatgcattctcttttattgttccatgaaacgggtgtcggtaaaacaatgactactgtata
tattctcaaacatcttaaggatatttatacgaattgggctattatcttattggtgaaaaaggctttgatagaagatccttggatgaacactatactcagat
acgctccagagataacgaaggattgtatttttattaattacgatgatcaaaattttagaaataaattttttactaatatcaaaactattaattccaagagt
agaatatgcgtcattattgatgaatgtcataacttcatttctaaatcattaatcaaagaagatggtaagatccgtcctactcgttcagtatataattttta
tctaagaccatcgcattaaaaaaccataagatgatttgtttatcggctacacctatcgttaatagtgtgcaagaattcaccatgttggttaacttactacg
accaggatccttacaacaccaatcgctatttgagaataaacgtctagttgatgagaaagaattagtctccaaactaggaggcctatgttcgtacatagt
taataacgagttttctattttttgatgacgtagaagggtctgcatcattcgctaagaaaacagtattaatgcgatacgttaatatgtcgaaaaagcaaga
agaaatttatcaaaaggctaaactcgctgaaataaaaacaggtatatcatcatttagaattctgagacgtatggctactacgtttacgttcgatagcttt
cctgaaagacaaaatcgtgatccgggcgaatacgcgcaagagatagcaacactatataatgattttaaaaattcattaagagatagagagtttttctaa
atccgcattagatacctttaaaaagggagaactattgaaaggggggatgctagtgcggctgatatctctctatttactgaattaaaagagaaaagcgtca
aatttatagatgtatgtttgggaatattagcatcccatggtaaatgtctagtctttgaaccatttgttaatcagtcaggaatagaaatcttattactatatt
tcaaagtctttggtatctctaatatagagttctcatctagaacaaaagatactagaatcaaggcggtggctgagtttaaccaagaatcaaacactaacg
gagaatgcattaaaacatgcgtattctcttctagtggaggcgagggtattagttttttttctcaattaatgatatcttcattttagatatgacatggaacgag

FIG. 13AK gcgtctcttcgtcagatagtaggaagagccattcgtctcaatagtcacgttcttactcctccagaacgtagatatgtaaacgtgcactttataatggcta
gattatctaatggtatgcctactgtagacgaagacctatttgaaatcattcaaagcaaatcaaaagaatttgtccaattgtttagagtgtttaaacatac
atcattagaatggattcatgctaatgaaaaagacttctcaccgatcgacaatgagtccggttggaaaaccttggtttcaagagccatcgatctatcgtct
aaaaaaaatattaccaataaactaattgagggtactaatatttggtattccaattctaatagattaatgtcaataaatagaggatttaaaggcgtagat
ggtcgagtatacgatgtagacggtaactatctacatgatatgccggacaatcccgttataaaaatacacgatggtaaattaatttatattttctaa >Gene184:103477..103686, 210 bp atgaagatatcattaattgagaaaaaactaataccctcgcctccactagaagagaatacgcatgttttaatgcattctccgttagtgtttgattcttggtt
aaactcagccaccgccttgattctagtatcttttgttctagatgagaactctatattagagataccaaagactttgaaatatagtaataagatttctattc
ctgactga >Gene185:104155..104427, 273 bp atgtacgaacataggcctcctagtttggagactaattctttctcatcaactagacgtttattctcaaatagcgattggtgttgtaaggatcctggtcgtag
taagttaaccaacatggtgaattcttgcacactattaacgataggtgtagccgataaacaaatcatcttatggttttttaatgcgatggtcttagataaa
aaattatatactgaacgagtaggacggatcttaccatcttctttgattaatgatttagaaatgaagttatga >Gene186:104424..104609, 186 bp atgacattcatcaataatgacgcatattctactcttggaattaatagttttgatattagtaaaaaatttatttctaaaattttgatcatcgtaattaataaa
aatacaatccttcgttatctctggagcgtatctgagtatagtgttcatccaaggatcttctatcaaagcctttttcaccaataa >Gene187:104890..105753, 864 bp atggatgaaattgtaaaaaatatccgggagggaacgcatgtccttcttccattttatgaaacattgccagaacttaatctgtctctaggtaaaagcccat
tacctagtctggaatacggagctaattactttcttcagatttctagagttaatgatctaaatagaatgccgaccgacatgttaaaactttttacacatgat
atcatgttaccagaaagcgatctagataaagtctatgaaattttaaagattaatagcgtaaagtattatgggaggagtactaaagcggacgccgtagt
tgccgacctcagcgcacgcaataaactgttcaaacgtgaacgagatgctattaaatctaataatcatctcactgaaaacaatctatacattagcgatta
taagatgttaaccttcgacgtgtttcgaccattatttgattttgtaaacgaaaaatattgtattattaaacttccaactttattcggtagaggtgtaatcga
tactatgagaatatattgtagtctctttaaaaatgttagactgctaaaatgcgtaagcgatagctggttgaaagatagcgccattatggtggctagtgat
gtttgtaaaaaaaatttggatttatttatgtctcatgttaagtccgtcactaagtcttcttcttggaaggatgtgaacagtgttcaatttagtattttaaaca
atccagtggatacggaattcattaataagttcttagagttttcgaatagagtatacgaagctctctattacgttcactcgttgctttattctagtatgactt
ctgattcaaaaagtatcgaaaacaaacatcagagaagactagttaaactactgctgtga >Gene188:105170..105358, 189 bp atggcgctatctttcaaccagctatcgcttacgcattttagcagtctaacatttttaaagagactacaatatattctcatagtatcgattacacctctaccg
aataaagttggaagtttaataatacaatatttttcgtttacaaaatcaaataatggtcgaaacacgtcgaaggttaacatcttataa >Gene189:105715..105933, 219 bp atgcgttccctcccggatattttttacaatttcatccatttacaactctatagtttgttttcattattattagttattatctcccataatcttggtaatacttacc
ccttgatcgtaagataccttatacaggtcattacatacaactaccaattgttttgtacataatagattggatggttgacatccatggtggaataaactac
tcgaacagatag >Gene190:105784..107439, 1656 bp atgaataatactatcattaattctttgatcggtggggatgactctattaaacggtctaatgtcttcgcagtcgatagtcaaattccaactttatatatgccg
caatatatttctctatccggagttatgacaaacgatggtccagacaatcaggctatcgctagcttcgaaattagggatcagtatattactgcgcttaatc

FIG. 13AL atttggttctgagtttggaacttccagaagttaaaggtatgggaagattcggttacgtaccatatgttggatataaatgtattaatcacgtatctatctctt
cgtgtaacggtgttatttgggaaattgagggcgaagaattatataataattgtatcaataatacaattgctttgaaacactctggatattctagtgaact
taatgatatttctattggcctaactcctaatgacacattaaagaaccatctacagtatacgtttatattaaaactccgtttgatgtggaagatacattca
gcagtcttaaactatccgattcaaaaattaccgtaacggtaaccttcaatccagtatccgatatcgttattcgtgactcttcgttcgactttgaaacgttc
aacaaagaatttgtttatgttcctgaattgagctttattggatatatggttaagaatgtacaaattaaaccatcgtttatagagaaacctaggagagtaa
taggtcaaataaaccaaccaacggcgactgtaactgaagttcatgcggcaacatcgctctctgtttatactaaaccttattatggaaatacggataata
aatttatttcgtatccagggtactcacaagatgaaaaagattatatagatgcatatgtgagtagattgttggatgatctagttattgttagtgatggccca
ccgactggttatccggagtctgccgagattgttgaggttccagaagatggtatcgtttctattcaagatgctgatgtgtatgtaaaaattgataatgttcc
tgataatatgagtgtttatcttcatactaatctgctaatgtttggaacacgaaaaaattctttttatatataacatttctaaaaagtttccgccattactgg
aacatatagtgatgccactaagagaacaatctttgctcacatatcacatagtatcaacatcatcgatacatctattcctgtaagtctttggactagtcaa
cgtaacgtctataacggagataatagatcagccgaatcaaaggccaaggatttgttcattaacgatcccttcatcaagggaatagattttaagaataa
gaccgatattatttctagactagaagttagatttggaaatgatgttctatattcagagaacggacccatctcgagaatttataatgaactactgacaaa
aagcaataatggaacaagaaccctaacttttaactttacaccaaagatattctttaggccgacaactattacggctaatgtatctaggggaaagata
aactatctgttcgagtagtttattccaccatggatgtcaaccatccaatctattatgtacaaaaacaattggtagttgtatgtaatgacctgtataaggta
tcttacgatcaaggggtaagtattaccaagattatgggagataataactaa >Gene191:106690..106914, 225 bp atgaacttcagttacagtcgccgttggttggtttatttgacctattactctcctaggtttctctataaacgatggtttaatttgtacattcttaaccatatatc
caataaagctcaattcaggaacataaacaaattctttgttgaacgtttcaaagtcgaacgaagagtcacgaataacgatatcggatactggattgaag
gttaccgttacggtaatttttga >Gene192:107463..107915, 453 bp atggctaagcgagtaagccttccagatgtggttatttcagcacctaaagcagtctttaagcccgctaaagaagaagcactcgcttgtatactaccaaag
tattataaatctatggcagatgtgtctattaagacaaatagtgtaattgataagtgttggttttgtaatcaagatttggttttaaacctattagtattgag
acattcaaggggtggtgaagttgggtatttctgttctaaaatatgtagggattcgttggcgtctatggttaagtctcacgtagctcttagagaagaaccaa
aaatttctttgttgcctttagtattctatgaagataaggaaaaggttatataacaataaacttactaagagataaagacggcgtttacggaagctgtta
ctttaaggaaaactcacaaattatagatatttctctacggagtttattgtaa >Gene193:107936..108610, 675 bp atgaatctacgattatgtagcggttgtagacacaacggtatagtatctgaacaaggatatgaatattgtattttttgcgagtcggtatttcaaaaatgta
caaaggtacaaaaaaagtcaaacttccatgtgtctaataaacttattcatttgagaaatgtattgcggagattattgtctcatcaatgttctggagaaat
tatctcggaactcttggatatcatggaaaaaaatcaaatatccacggatgatgtagatgcaaattttgtatctagttttcttaaggctaacgagagaata
aataaaaaggattataagttagtctttgaaataatcaatcaagtaaaagatgagaaactgaatctgagtacagaaaagattaatgaagtagtagaaa
tatttaagcacttggtattctttttgccaagaaaacactccttctaagacaattaattattcattctttttggataaaatattcgatatcacttctgtaactaa
aaatctaaaacctcaaactgttaaaaattatacgaaaaataatagtaaccaattagtatgggaaaacttttttagcacatatgagatctaaaaaacgtg
taactatggtagaggattatggacacgagtatgttttttgtagatgagaggttttctacttgctcattagaagtataa >Gene194:108607..108837, 231 bp atgagttggtacgaaaaatataacattgtactgaatccgcctaagcggtgttcttttgcatgtgcggataatttaactactatattggcggaagacggta
acaatattagggcgatactttattcacagcccaaaaaactaaaaatattacaggattttctggcaacgtctagaaataaaatgtttttatataaaatatt
ggacgacgagatacgtagagtgttaacatga >Gene195:108852..110786, 1935 bp

FIG. 13AM atggaagccgtggtcaatagcgatgtttttttaacatctaacgcaggactaaaatctagttatactaatcaaactctttctttggtagatgaagatcatat
tcacacttctgataaatctttgtcttgtagtgtatgcaattcattatccaaaattgtagacgatgactttatatctgcaggggctagaaatcaacgtacca
aacctaaacgtgcaggaaataatcaatctcaacagcctatcaaaaaggattgtatggtttccatcgacgaagtagcatctacacatgattggagtacg
agattgagaaatgatgggaatgcaattgctaaatatctaactactaacaagtatgacacatctaactttactattcaggatatgcttaacattatgaata
aactaaatattgtcagaacaaatagaaacgagctatttcaactccttacccatgtaaagagcacattgaacaatgctagtgtttctgtgaaatgtactc
atcctttagtacttattcattctcgagctagtcctagaatcggtgaccaactcaaagagttagataaaatatactctccatctaatcatcatattcttctgt
cgactacacgattccaatccatgcattttaccgatatgtctagttcacaagatttgtcttttatttatagaaaaccagaaactaattactatattcatccta
ttctgatggcactattcggtattaaacttcctgcgctcgagaacgcgtatgtacatggagacacctatagcctaatccagcaactttatgaatttagaaa
agtaaagtcttataattatatgttgttggttaatcgtcttacggaggataatccgatagtgattacaggtgtatcagatctaatttccacagagattcaga
gagcaaacatgcataccatgattagaaaagcaattatgaacattagaatgggaattttttattgtaacgatgatgatgcggtagatccccatctaatga
agattattcatactggatgctctcaagttatgacagatgaggaacagatattggcttctattttgtctatagttggatttagacctacgttggtttctgtgg
ctagacctataaacggcatcagttacgatatgaaacttcaggcggcaccatacatagttgttaatcctatgaagatgatcacaacatccgacagtccg
atttctatcaattccaaggatatttattctatggcattcgatggcaatagtggaagagtggtgttcgctcctcctaacataggatatggaagatgttctgg
agttacacacattgatccattgggaactaatgtgatgggtagtgctgttcattcccctgttatcgttaatggagcaatgatgtttatgtagaacgacgtc
agaataagaatatgtttggtggagaatgttacaccggctttagatctctaatagatgatactccgattgacgtatcaccagaaatcatgctaaacggta
tcatgtataggttaaagtccgcagtttgttacaaactcggagaccaattctttgattgtggatcgtctgatatcttcttgaagggacattatacgattctat
ttacagaaaatggaccctggatgtacgatcctctttctgttttcaatccgggagctagaaatgctagattgatgcgagctctcaaaaaccagtacaaga
aattatcaatggattcagacgatggttttttatgaatggttgaatggcgacggttcagtatttgctgcctcaaaacagcaaatgttgatgaatcacgttgc
taactttgacgacgatcttctaactatggaagaagccatgtcgatgatttcgagacattgttgtatcttaatttatgcacaggattatgatcaatatatta
gcgctagacatattacagaactattttag >Gene196:109431..109790, 360 bp atgaacagcactacccatcacattagttcccaatggatcaatgtgtgtaactccagaacatcttccatatcctatgttaggaggagcgaacaccactctt
ccactattgccatcgaatgccatagaataaatatccttggaattgatagaaatcggactgtcggatgttgtgatcatcttcataggattaacaactatgt
atggtgccgcctgaagtttcatatcgtaactgatgccgtttataggtctagccacagaaaccaacgtaggtctaaatccaactatagacaaaatagaa
gccaatatctgttcctcatctgtcataacttgagagcatccagtatgaataatcttcattag >Gene197:110839..111690, 852 bp atggacttctttaacaagttctcacaggggctggcagaatcctctacaccaaagtcgtcaatctattattctgaaaaaaaggatccggatacgaaaaa
ggatgaagcgattgaaataggactaaagtctcaagagtcgtattatcaaagacagttgcgagaacaactagctagagataatatgatggccgccagc
agacagcctatccaaccgctacaaccaactattcatataactccacagccggttccggttccgacacctacatcggctcctattcttctacctagtagta
ctgctcctacaccaaaaccacgacaacaaactaatacatcatctgatatgtctaatcttttttgattggctgtctgcagatactgatgcgccggcgagttc
actccttccagcgttgacgccgagcaatgctgttcaggatattatctctaaatttaataaagatcaaaagacgacgacaccgccatctacccaaccttc
tcagacgttaccaacaactacatgtacacaacaatcggatggaagtatttcttgtactactccaacggttacacctcctcaacctcctattgtggccact
gtatgtactcctacacctactggtggtacagtatgtacaacagcacaacaaaatccaaatccaggagcagcatctcaacaaaatctagacgatatggc
ccttaaggatctcatgtcgagtgttgaaaaagatatgcaccaacttcaggccgaaacaaacgatctggtgacgaacgtatatgatgcaagggagtat
acgcgtaggggcaatagatcaaattctacaactagtcaaaggttttgaacgattccaaaagtaa >Gene198:111728..112222, 495 bp atggcagacacagacgatattatcgactatgaatccgatgatctcactgaatacgaggatgatgaagaagaggaagaagatggagagtcactagaa
actagtgatatagatcccaaatcttcttataagattgtagaatcagcatccactcatatagaagatgcgcattccaatcttaaacatatagggaatcata
tatctgctcttaaacgacgctatactagacgtataagtctatttgaaatagcgggtataatagcagaaagctataacttgcttcaacgaggaagattac
ctctagtttcagaattttctgacgaaacgatgaagcaaaatatgctacatgtaattatacaagagatagaggagggttcttgtcctatagtcatcgaaa

FIG. 13AN agaacggagaattgttgtcggtaaacgattttgacaaagatggtctaaaattccatctagactatattatcaaaatttggaaacttcaaaaacgatatt
ag >Gene199:112219..113337, 1119 bp atggacaaacttagagttctatacgatgagttcgtcaccattagtaaagataatcttgaacgcgagactggtcttagcgcatcagatgttgatatggatt
ttgatttaaacatttttatgacgttggttccagtcttggagaaaaaggtatgcgctattacaccaactatagaagatgataaaatcgtaactatgatgaa
atattgtagttatcagagttttcattctggttccttaaatctggtgccgttgtgaaatcggtatataataaactagatgatgtgaaaaaggaaaagtttg
tagccacatttagagacatgttgcttaatgtacaaactctaatctctcttaactctatgtatactagactgcgtcaagataccgaagatatagtatccgat
tccaaaaaaataatggagatcgtttcccatttgagagcgtcgactacagagaacgcggcgtatcaagttctccaacaaaacaatagttttatcatatct
acactaaataaaatcttatctgatgaaaactatctcttgaaaattattgcagtattcgactctaaactaatttctgaaaaggagacattgaatgaataca
aacaattgtacaccatttcttctgaaagtttggtatacggaatcagatgcgttagtaatctggatatatcatctgttcaactgagtaacaataaatacgtt
ctctttgttaagaaaatgctacctaaaatcatactgtttcagaataacgacatcaatgcacaacaattcgctaatgttatttctaaaatttatacgttgat
ttatagacaattgacgtcgaatgtcgatgttggatgtctattgacagatacgatagaatctgccaaaactaaaatatctgtagaaaaaattaaacaga
cgggtattaataatgttcaaagtcttatcaaattcatatcggataacaagaaagaatataagacaataatctctgaagaatatctatcgaaggaagat
agaatcattactattttgcaagatatcgttaatgaacacgatataaagtacgacaataaattgctgaacatgcgagacttgattgtgacatttagagaa
cgatattcgtataaattctaa >Gene200:113018..113125, 108 bp atgtctctaaatgtggctacaaacttttcctttttcacatcatctagtttattatataccgatttcacaacggcaccagatttaaggaaccagaatgaaaa
actctga >Gene201:113361..115493, 2133 bp atgcgatatatagtaagtccgcaattggtattacaggtgggtaaggggcaggaggtagaacgagccctatatctcactccatatgattacatagatga
gaagtcgcccatatattatttttacgaagtcatttaaatatacaacagccggaaatagttaagagacatattctattgacgcttcgaatgactcaatta
aagggatatttaggaaatttgttagatattaaggacgatattattatctattctcataagaataatttggaatatagttacgttgataatactatttttaat
cccttcgtatacacgcagaaaaaaaccctactaaaaaacgatagcttttatacaatgtatatcctggagcgtgtgacttttggttatctgggtggcca
gagcgtgcgatacatctattccggaatttggatcgtacgaagatgtagataataatattatcaagtttgaaacaatgttgatggaagtatttccacaact
agatttggacattactatagaatcaaagtttaacaatatatttcgtaccaatctaaaactaactgggttaaaaaagatcattcagcgagttcaagactt
ggacattaattataagtcgttgttatctagatacgatgaacactttattaatatgaccggtaatcattttattctaaacgatgaacagttaaatctctccat
ttgggacttggatggtacattagcgttatctagcgacggcgataccgtgatgattaataacgtaaaactatttacagatcttgtgtccgatatagataca
caaatggaacgcatcaagggagatataacgtataaggtacatttggcgactcctatcaattctagaataaaattggatatcgagactagcttcattttt
atagagacggcgactaataatatttttactatcctcggataaaaaaatatctatcattttggccaaaaaccatatatctattaaagtgaaaaaccatattc
ctaacatagaaaaatattttacatttttagttattgccattaatgccatgtttaatagcgttcaaaagtctgctgattttaccaaagtggaaactgtttact
ggtctaggatatgccaaaatacaaagaataagaatagaaaacccatcattattaattatctagatcctggaatgaaaaaaaatcagtaacaacttttac
agatccgatgagaagaagtctttattaatgataacggcataatgtttacgtgcatggatcctttggggaaatataataaggtgggatttcttaatatat
ttcatgatatgcggaaatattgtatccttgttgttttctacatgatcaatctcatagaagcacattttcatcgtgtgttcatcaaattgacgttgagaaaa
agatagtaagtccgtatatccttaattttggtaaagtcgtaacagaatccaaaatgtcatttctccctattattttttgacgccttcttaaatgatggaatga
ctgctaatatggaacaagataataaacggctaaaggaaactagtggatatcatatagttagatgttgtgctggtgatgatatagttcgtttacgaacta
catctgatattattcagtttgtaaacgaggataaaaatattcttatagttaacgacatggtatatatttccaatgaacgcgtccgataggaaagaaaat
acatatactcattcaagaaatagttcatgaggtaatgatagtaaaaaagaaagagtctagtgataaaatcgattttttcccacccaactataagttatt
gaaggatctatttccaaaacaaactattcaaactcctattcaatctgacgcgggaatggtgttaacaaccgatggattctacatagatggaaaactttt
aacgaagatctgtcgtctaaatacgttacatttacaaaaaatgttattgcgtctgatgccgtagctaaatattttttctcctttgtttaaatacgttatttcag
aagctaaagatagatttatcaaaacgtggatgattaatattatgatacatgaacgtagatcctaataatataataccgacgttagaaaaatactatc
ccaactctggaagagcacaaataaattaa

FIG. 13AO

>Gene202:114445..114831, 387 bp atggcattaatggcaataactaaaaatgtaaaatattttctatgttaggaatatggtttttcactttaatagatatatggttttggccaaaatgatagat
atttttttatccgaggatagtaaaatattattagtcgccgtctctataaaaatgaagctagtctcgatatccaatttattctagaattgataggagtcgcc
aaatgtaccttatacgttatatctcccttgatgcgttccatttgtgtatctatatcggacacaagatctgtaaatagttttacgttattaatcatcacggtat
cgccgtcgctagataacgctaatgtaccatccaagtcccaaatggagagatttaactgttcatcgtttagaataaaatga >Gene203:114913..115218, 306 bp atgatctttttaacccagttagtttagattggtacgaaatatattgttaaactttgattctatagtaatgtccaaatctagttgtgggaaatacttccatca
acattgtttcaaacttgataatattattatctacatcttcgtacgatccaaattccggaatagatgtatcgcacgctctggccacccagataaccaaaaa
gtcacacgctccaggatatacattgtataaaaagctatcgtttttttagtagggtttttttctgcgtgtatacgaagggattaaaaatagtattatcaacgt
aa >Gene204:115547..116413, 867 bp atgttcgaaccagtaccagatcttaatttggaggcctccgtagaactaggggaggtaaatatagatcaaacaacacctatgataaaggagaatagcg
gtttatatcccgcagtagacgtctattcgcccatagatctaaggatgatgagagaaaactagcactacgattctttttacaaagactttatttttttagat
catagagagattcattatttgttcagatgcgttgacgctgtaaaagacgtcactattaccaaaaaaaataacattatcgtggcgccttatatagcacttt
taactatcgcatcaaaaggatgcaaacttacagaaacaatgattgaagcattcttccagaactatataatgaacatagtaagaaatttaaattcaact
ctcaagtatccatcatccaagaaaaactcggataccagtttggaaactatcacgtttatgattttgaaccgtattactctacagtagctctggctattcga
gatgaacattcatctggcatttttaatatccgtcaagagagttatctggtaagttcattatctgaaataacatatagatttttatctaattaatctaaaatct
gatcttgttcaatggagtgctagtacgggcgctgtaattaatcaaatggtaaatactgtattgattacagtgtatgaaaagttacaactggtcatagaa
aatgattcacaatttacatgttcattggctgtgtggaatcaaaacttccaataaaaattacttaaagatagaaatgaattatttacaaaattcattaacgagt
taaaaaagaccagttcattcaagataagcaaacgcgataaggatacgctactaaaatattttacttag >Gene205:115907..116053, 147 bp atgttcatctcgaatagccagagctactgtagagtaatacggttcaaaatcataaacgtgatagtttccaaactggtatccgagttttcttggatgatg
gatacttgagagttgaatttaaatttcttactatgttcattatatag >Gene206:116406..116705, 300 bp atgtcatgttatacagctatattaaaatctgtaggaggactggcgctatttcaagtagccaatggcgccatagatttatgtagacatttctttatgtatttt
tgtgaacaaaagctacgaccaaattcattttggttcgtcgttgttagagccattgcaagcatgataatgtatttagtattaggcatagcattgctgtatat
ttctgaacaagataacaagaagaatactaataatgatggtagtaataatgataaacgaaatgagtcgtctataaattctaactccagtcctaagtaa >Gene207:116706..119381, 2676 bp atgatgcctattaagtcaatagttactcttgatcaattagaggactctgaatatttatttcgtatagtttctaccgttcttccgcatctatgtctagattaca
aagtatgcgacaaactcaaaacaaccttcgttcatccgttcgatatattgcttaataactcattaggatccgtaactaaacaagatgagcttcaggctg
ctatatccaaattgggcattaattatttaattgatactacttcacgtgaattaaaactgtttaatgttacacttaacgctggaaatatagatattattaata
ccccaattaacattagttcggaaactaatcctatcattaatactcacagcttttacgatcttccacctttcactcaacaccttcttaatattagattgacgg
atacagaatacagagctagatttatcggtggttatattaaaccagatggctccgactcaatggatgttctagcagaaaagaaatatccagatcttaact
ttgataacacttatttgtttaacatcctctataaggatgttattaatgcaccaataaaagaattcaaggcaaaaattgttaacggtgtattaagcagaca
agattttgataatcttataggtgttagacaatatataacaatacaagatcgaccccgctttgacgacgcttataacatcgcagatgctgctagacattat
ggagttaatcttaatacattgccattaccaaacgtcgatctcactactatgccaacatataaacatctcatcatgtttgaacagtacttcatttatacata
tgacagagtggatatttattacaatggtaacaaaatgctcttcgatgatgagattataaactttactatttctatgcgatatcaatc138

FIG. 13AP tcttattcctagactggtagatttctttccagatataccagtaaacaataacatcgtacttcatactcgcgatcctcaaaatgctgcagtgaatgtaaccg
tggcgcttccaaacgtgcaatttgtggacataaatagaaacaacaaattctttattaatttctttaacctgttggcgaaggaacaaagatctacggctat
caaagttaccaaatccatgttttgggacggtatggattacgaggaatacaagtctaaaaaccttcaggacatgatgtttataaattctacctgttatgta
ttcggtctttataatcacaataatactacttattgctctatcctttctgatattatctccgcagagaaaacacctattagagtttgtttgttacccagagtag
tcggaggtaagactgttactaatcttatttcagaaactttgaagagtatttcatctatgactatacgagagtttcccaggaaagatctaaatctatcatgca
tataggactttctgagacgggattcatgagattcttccaactactcaggctcatggctgataaacctcatgaaacggctattaaagaggttgttatggct
tatgtgggtataaagttgggtgacaaaggtagtccgtactatattagaaaggagtcataccaagactttatctatctgctattcgcatcaatgggcttta
aggtgactactagaagatccattatgggaagcaataatatctctatcatcagtattagaccaaaagtaactaaacaatacatcgtcactacattgatga
aaactagttgtagtaaaaacgaggcagaaaaattaattacttcagcgtttgatcttctcaatttcatggtatcagttagtgactttagagattatcagag
ttacagacagtatagaaactattgtcctagatatttctatgcaggatctcccgaaggagaggaaaccattatctgtgactcggaaccgataagtatctt
ggatagaattgatactcgtggtatcttttctgcgtatactattaatgaaatgatggacactgatatctttctccagagaataaggcatttaagaataatc
tgagtagatttatcgagagtggagatattacaggagaagatattttctgcgcaatgccatacaacatcttagataggattattacaaatgctggtacgt
gtaccgtatccataggtgatatgttggataacattacaacccagtcagactgtaatatgactaacgaaatcacagatatgataaacgcctcattgaag
aatacaatttctaaagataataatatgctagtcagccaagcattggactctgtagctaatcgttctaaacaaacgattggagacttgaggcaatcatcg
tgtaagatggcattgttgtttaaaaatcttgttacatccatctacacaatagaacgtattttcaatgctaaagtaggccgatgatgttaaggcatcgatgtt
ggagaagtataaagtattcacagatatttccatgtcattgtataaagacttgatagctatggagaatctcaaagcgatgctatacattattcgacgaag
cggatgcagaatagacgatgcacaaattactactgacgatctagtcaagtcttactcattgatccgtcctaaaattctaagtatgataaactattataat
gaaatgagtagaggatactttgaacacatgaaaaaaaatctaaatatgacagatggtgactctgtctctttttgatgatgaataa >Gene208:117049..117549, 501 bp atggatgtaacaagatttttaaacaacaatgccatcttacacgatgattgcctcaagtctccaatcgtttgtttagaacgattagctacagagtccaatg
cttggctgactagcatattattatctttagaaattgtattcttcaatgaggcgtttatcatatctgtgatttcgttagtcatattacagtctgactgggttgta
atgttatccaacatatcacctatggatacggtacacgtaccagcatttgtaataatcctatctaagatgttgtatggcattgcgcagaaaatatcttctcc
tgtaatatctccactctcgataaatctactcagattattcttaaatgccttattctctggagaaaagatatcagtgtccatcatttcattaatagtatacgc
agaaaagataccacgagtatcaattctatccaagatacttatcggttccgagtcacagataatggtttcctctccttcgggagatcctgcatag >Gene209:117619..117813, 195 bp atgaaattgagaagatcaaacgctgaagtaattaatttttctgcctcgttttttactacaactagttttcatcaatgtagtgacgatgtattgtttagttactt
ttggtctaatactgatgatagagatattattgcttcccataatggatcttctagtagtcaccttaaagcccattgatgcgaatagcagatag >Gene210:117931..118158, 228 bp atgagcctgagtagttggaagaatctcatgaatcccgtctcagaaagtcctatatgcatgatagatttatctttcctgggaaactctcgtatagtcatag
atgaaatactcttcaaagtttctgaaataagattagtaacagtcttacctccgactactctgggtaacaaacaaactctaataggtgttttctctgcgga
gataatatcagaaaggatagagcaataa >Gene211:118425..118652, 228 bp atgaagtacgatgttattgtttactggtatatctggaaagaaatctaccagtctaggaataagagattgatatcgcatagaaatagtaaagtttataat
ctcatcatcgaagagcattttgttaccattgtaataaatatccactctgtcatatgtataaatgaagtactgttcaaacatgatgagatgtttatatgttgg
catagtagtgagatcgacgtttggtaa >Gene212:119396..120352, 957 bp atgacgaccgtaccagtgacggatatacaaaacgatttaattacagagttttcagaagataattatccatctaacaaaaattatgaaataactcttcgt
caaatgtctattctaactcacgttaacaacgtggtagatagagaacataatgccgccgtagtgtcatctccagaggaaatatcctcacaacttaatgaa
gatctatttccagatgatgattcaccggccactattatcgaacgagtacaacctcatactactattattgacgatactccacctcctacgtttcgtagaga

FIG. 13AQ gttattaatatcggaacaacgtcaacaacgagaaaaaagatttaatattacagtatcgaaaaatgctgaagcaataatggaatctagatctatgataa
cttctatgccaacacaaacaccatccttgggagtagtttatgataaagataaaagaattcagatgttagaggatgaagtggttaatcttagaaatcaac
gatctaatacaaaatcatctgataatttagataatttttaccaaaatactatttggtaagactccgtataaatcaacagaagttaataagcgtatagccat
cgttaattatgcaaatttgaacgggtctcccttatcagtcgaggacttggatgtttgttcagaggatgaaatagatagaatctataaaacgattaaaca
atatcacgaaagtagaaaacgaaaaattatcgtcactaacgtgattattattgtcataaatattatcgagcaagcattgctaaaactcggatttgaaga
aatcaaaggactgagtaccgatatcacttcagaaattatcgatgtggagatcggagatgactgcgatgctgtagcatcaaaactaggaatcggtaac
agtccggttcttaatattgtattgtttatactcaagatattcgttaaacgaattaaaattatttaa >Gene213:120354..120932, 579 bp atggcggataaaaaaaatttagccgttagaagcagttacgatgattatatcgaaacagttaataagattacaccacagcttaaaaatctactagcgca
aatcggtggagatgcagccgtcaaaggaggcaacaataatcttaattctcaaacagatgtgactgccggcgcatgtgatacaaaatcaaagagttca
aaatgtattacatgtaaaccaaaatcaaaatcctcgtcttcttctacatcagcctccaagggctccaaaaatacttctggtgctcctaaacgtagaaca
acagttactactacatcgtacaatgcgatggatggtcagattgtccaagctgttactaatgctggtaaaatagtttatggtaccgtcagagacggccaa
ttagaagttcgtggaatggtcggagagatcaatcacgatcttctaggtatcgactcagttaatgctgggaaaaagaaaccatctaaaaagatgcccac
taataaaaagattaatatgtcgtccggtatgagacgacaggaacagattaatccagacgattgttgtctggatatgggaatgtattaa >Gene214:120956..121168, 213 bp atgattggtattcttcttttgatcggtatttgtgtagcagttactgtcgccatcctatactcgatgtataataagatcaagaacttacaaaatctgaatcca
agtccgaatttaaattcgcctcctccagaaccaaaaaataccaagtttgtaaataatctggaaaaggatcatattagttcattgtataatctagttaaat
cttctgcataa >Gene215:121276..121548, 273 bp atggacatgatgcttatgattggaaattattttttccggcgtgctaatcgctggaatcattctttttgattctttcgtgtatcttcgcctttattgactttagtaa
gtctaccagtcccactcgtacatggaaagtattgagtattatggcgtttatacttggtattattatcacagtcggaatgctaatttattctatgtggggaa
agcactgcgcaccccacagagttagcggagtcattcacaccaatcatagcgatatttccatgaactaa >Gene216:121565..121726, 162 bp atgataagtaattacgagccgttgctgctgttagttataacatgctgtgtactactatttaattttaccatatcttcgaaaacaaaaatagatattattttt
gcagtacaaactattgttttttatatggtttatattccactttgttcattcggcgatttaa >Gene217:121716..122000, 285 bp atgttcgtagacgataattcgttgataatttattctacatggcccagtacattgtccgattcatcaggtagagtcatcgttatgccagataatagatcatt
cacgtttaaggaagggtttaaattagatgaatcgataaaatctatattgttggtaaacccgtcgtctatagatctattaaagattagagtatataaacat
cgcataaaatggatgggtgatatattcgtattatttgagcaagaaaatatcccaccaccttttcgtctagtaaatgataagtaa >Gene218:121795..121971, 177 bp atgcgatgtttatatactctaatctttaatagatctatagacgacgggtttaccaacaatatagatttttatcgattcatctaatttaaacccttccttaaac
gtgaatgatctattatctggcataacgatgactctacctgatgaatcggacaatgtactgggccatgtagaataa >Gene219:121984..123117, 1134 bp atgggggcagctgttactcttaatagaatcaaaatagcaccaggaatagcagatatacgagacaaatatatggaattaggttttaattatcctgaatat
aatagagctgttaagtttgcagaagaaagttatacgtactattatgaaacatctccgggagaaattaaacccaagttttgtttgatagatggtatgtcg
atagatcattgtagtagttttatagttcctgaatttgctaaacaatatgtattaattcatggagaaccatgtagttctttcaaatttcgtcctggatcattaa

FIG. 13AR tctattatcagaacgaggtaactcctgaatatattaaggatttaaaacacgctactgattatatagcatccgggcaacgatgtcattttataaaaaagg
attatctcctgggcgatagtgatagcgtagcaaaatgttgttctaagacaaataccaaacactgtccaaaaatatttaataataattacaagacagaa
cattgtgacgatttcatgactggattttgtagaaacgatcctggaaaccccaattgtttagaatggttacgtgcaaaacggaaaccggctatgtctactt
attccgatatttgctccaaacatatggatgcgagatattgttctgagtttattagaattattcgtcctgattattttacttttggggatacggcattatacgt
cttttgtaacgatcataaaggaaatagaaattgttggtgcgcgaattatccaaaatctaattccggagataaatatttaggacctagggtatgttggtta
catgagtgcaccgacgaatctagagatagaaaatggttatattataatcaagatgttcaaagaactagatgtaaatacgttgggtgcacgattaacgt
taactctttagcgttaaaaaattcccaagcggaacttacgtctaattgtactagaactacgtccgccgttggtgacgtacatccaggagaacctgtagt
aaaagataaaataaaactgcctacctggttgggcgcggccataacactggttgtaatatctgttattttctattttatatccatttattcgcgtcctaaaat
taaaacaaatgatataaatgttcgtagacgataa >Gene220:122078..122260, 183 bp atggccgcgcccaaccaggtaggcagttttattttatcttttactacaggttctcctggatgtacgtcaccaacggcggacgtagttctagtacaattaga
cgtaagttccgcttgggaattttttaacgctaaagagttaacgttaatcgtgcacccaacgtatttacatctagttctttga >Gene221:122617..122775, 159 bp atgttctgtcttgtaattattattaaatattttggacagtgtttggtatttgtcttagaacaacattttgctacgctatcactatcgcccaggagataatcct
tttttataaaatgacatcgttgcccggatgctatataatcagtagcgtgttttaa >Gene222:123120..123731, 612 bp atgagttatttaagatattacaatatgcttgacgacttctctgcgggtgctggagtgcttgataaagatttatttacagaggaacagcagcaatcgtttat
gcctaaagatggaggtatgatgcaaaacgattatggaggaatgaatgattatttgggaatcttcaaaaataatgatgttagaacgttactcggtttgat
tttgttcgtcttggctctatatagccctcctctaatctctatattgatgatatttatctcatcttttctattgcctcttactagcttagttattacctattgcttag
taactcaaatgtatcgtggaggtaatggcaacactgtgggaatgtctattgtgtgtattgtagctgctgtaattattatggcaatcaatgtatttacgaat
tcacagatatttaatattatttcttacattattttgtttattctgttctttgcatatgtgatgaacatcgaaagacaggactatagaagaagtataaatgta
accattcctgaacagtatacctgcaacaaaccttatactgcgggaaataaggtagatgttgatataccaacatttaacagtttaaatactgacgattatt
aa >Gene223:123746..125227, 1482 bp atgtcactattaaagatggagtataatctttatgccgaactaaaaaaaatgacttgtggtcaacccctaagtcttttaacgaagacggggatttcgtag
aagttgaaccgggatcatcctttaagtttctgatacctaagggattttacgcctctccttccgtaaagacgagtctagtattcgagacattaacaacgac
cgataataaaatcactagtatcaatccaacaaatgcgccaaagttatatcctcttcaacgcaaagtcgtatctgaagtagtttctaatatgaggaaaat
gatcgaatcaaaacgtcctctatacattactcttcacttggcgtgtggatttggtaagactattaccacgtgttatcttatggctacacacggtagaaaa
accgtcatttgcgtacccaataaaatgttaatacatcaatggaagacacaggtagaggcagtcggattggaacataagatatccatagatggagtaa
gtagtctattaaaggaactaaagactcaaagtccggatgtattaatagtagtcagtagacatctgacaaacgatgccttttgtaaatatatcaataagc
attatgatttgttcatcttggatgaatcacatacgtataatctgatgaacaatacagcagttacaagattttagcgtattatcctccgatgatgtgttatt
ttttaactgctacacctagaccatctaacagaatttattgtaacagtattattaatattgccaagttatccgatctaaaaaaaactatctatgcggtagat
agttttttgagccatattccacagacaatattagacatatgataaaacgattagatggaccatctaataaatatcatatatatactgagaagttattat
ctgtagacgagcctagaaatcaacttattcttgataccctggtagaagaattcaagtcaggaactattaatcgcattttagttattactaaactacgtga
acatatggtattcttctacaaacgattattagatctttcggaccagaggttgtatttataggagacgcccaaaatagacgtactccagatatggtcaaa
tcaatcaaggaactaaatagatttatattcgtatccaccttatttattccggtactggtttagatattcctagtttggattcgttgttcatttgctcggcagt
aatcaacaatatgcaaatagagcaattactagggagggtatgtcgagaaacagaactattagataggacggtatatgtatttcctaacacatccatca
aagaaataaagtacatgataggaaatttcatgcaacgaattattagtctgtctgtagataaactaggatttaaacaaaaaagttatcggaaacatcaa
gaatccgatcccacttctgtatgtacaacatcctccagagaagaacgtgtattaaatagaatatttaactcgcaaaatcgttaa

FIG. 13AS

>Gene224:124888..125076, 189 bp atgaaatttcctatcatgtactttatttctttgatggatgtgttaggaaatacatataccgtcctatctaatagttctgtttctcgacataccctccctagta
attgctctatttgcatattgttgattactgccgagcaaatgaacaacgaatccaaactaggaatatctaaaccagtaccggaataa >Gene225:125208..125441, 234 bp atggatagcaccaatgtgcgttccggaatgaagagccgcaaaaagaagcccaagactacagttatcgatgacgatgatgattgcatgacgtgttctg
cctgtcagtctaaattggttaagatttccgacatcacaaaagtatcattggattatattaatactatgaggggtaatacactggcctgcgcagcatgcgg
atcgtcgcttaaacttcttaacgattttgcgagttaa >Gene226:125442..125795, 354 bp atgataactttatttttaatcctatgttatttcattcttatttttaatattatagtacctgcaatatctgaaaaaatgagacgcgaacgagccgcatacgta
aactacaaacgtctaaacaagaatttcatttgtgtcgatgatagactgtttagttataattttacaacatctggaattaaggcaaagatggccgttgata
acaaaaatgttcccattccatgttccaagataaacgaggtcaataataataaagatgtcgatacactatattgtgataaagatagagacgatatacca
ggttttgcacgatcgtgctatagggcatattctgacttatttttttactacctaa >Gene227:125794..127074, 1281 bp atgacttctagcgctgatttaactaacttaaaagaattacttagtctgtacaaaagtttgagattttcagattctgcggctatagaaaagtataattcttt
ggtagaatgggggaacatctacttactggaaaataggcgtgcaaaaggtagctaatgtcgagacgtcaatatctgattattatgatgaggtaaaaaata
aaccgtttaatattgatccgggctattacattttcttaccggtatattttgggagcgtctttatttattcgaagggtaaaaatatggtagaacttggatctg
gaaactcttttcaaataccagatgatatgcgaagtgcgtgtaacaaagtattagacagcgataacggaatagactttctgagatttgtttgttaaaca
atagatggataatggaagatgctatatcaaaatatcagtctccagttaatatatttaaactagctagtgagtacggattaaacataccaaatatttag
aaattgaaatagaggaagacacattatttgacgacgagttatactctattatagaacgctctttcgatgataaatttccaaaaatatccatatcgtatat
taagttgggagaacttaggcggcaagttgtagacttttcaaattctcgttcatgtatattgagtccatcaaggtagatcgtataggagataatatttta
ttcctagcgttataacaaaatcaggaaaaaagatattagtaaaagatgtagaccatttaatacgatccaaggttagagaacatacatttgtaaaagta
aaaaagaaaaacacattttccattttatacgactatgatggaaacggaacagaaactagaggagaagtaataaaacgaattatagacactatagga
cgagactattatgttaacggaaagtatttctctaaggttggtagtgcaggcttaaagcaattgactaataaattagatattaatgagtgcgcaactgtcg
atgagttagttgatgagattaataaatccggaactgtaaaacgaaaaatataaaaaccaatcagcatttgatttaagcagagaatgtttgggatatcca
gaagcggattttataacgttagttaataacatgcggttcaaaatagaaaattgtaaggttgtaaatttcaatattgaaaatactaattgtttaaataacc
cgagtattgaaactatatatggaaactttaaccagttcgtctcaatctttaatatcgtcaccgatgtcaaaaaaagattattcgagtga >Gene228:126228..126614, 387 bp atggaaaatgtgttttctttttttactttttacaaatgtatgttctctaaccttggatcgtattaaatggtctacatcttttactaatatcttttttcctgattttgt
tataacgctaggaataaaaatattatctcctatacgatctaccttgatggactcaatatacatgaacgagaatttgaaaaagtctacaacttgccgcct
aagttctcccaacttaatatacgatatggatattttggaaatttatcatcgaaagagcgttctataatagagtataactcgtcgtcaaataatgtgtctt
cctctatttcaatttctaaatatttgggtatgtttaatccgtactcactagctagtttaaatatattaactggagactga >Gene229:126696..126917, 222 bp atgttattaactaacgttataaaatccgcttctggatatcccaaacattctctgcttaaatcaaatgctgattggttttttatttttcgttttacagttccgga
tttattaatctcatcaactaactcatcgacagttgcgcactcattaatatctaatttattagtcaattgctttaagcctgcactaccaaccttagagaaata
ctttccgttaacataa >Gene230:127004..127567, 564 bp

FIG. 13AT atggaaactttaaccagttcgtctcaatctttaatatcgtcaccgatgtcaaaaaaagattattcgagtgaaataatatgcgcctttgatataggtgcaa
aaaatcctgccagaactgttttagaagtcaaggataactccgttagggtattggatatatcaaaattagactggagttctgattgggaaaggcgcatag
ctaaagatttgtcacaatatgaatacactacagttcttctagaacgtcagcctagaaggtcgccgtatgttaaatttatctattttattaaaggctttttat
atcatacatcggctgccaaagttatttgcgtctcgcctgtcatgtctggtaattcatatagagatcgaaaaaagagatcggtcgaagcatttcttgattg
gatggacacattcggattgcgagactccgttccggatagacgcaaattagacgatgtagcggatagtttcaatttggctatgagatacgtattagataa
atggaatactaattatacaccttataataggtgtaaatctagaaattacataaaaaaaatgtaa >Gene231:127269..127454, 186 bp atgttaaatttatctattttattaaaggcttttttatatcatacatcggctgccaaagttatttgcgtctcgcctgtcatgtctggtaattcatatagagatcg
aaaaaagagatcggtcgaagcatttcttgattggatggacacattcggattgcgagactccgttccggatagacgcaaattag >Gene232:127587..128735, 1149 bp atggataatctatttacctttctacatgaaatagaagatagatatgccagaactattttaactttcatctaataagttgcgatgaaataggagatatata
tggtcttatgaaagaacgcatttcctcagaggatatgtttgataatatagtgtataataaagatatacatcctgccattaagaaactagtgtattgcgac
atccaacttactaaacacattattaatcagaatacgtatccggtatttaacgattcttcacaagtgaaatgttgtcattatttcgacataaactcagataa
tagcaatattagctctcgtacagtagagatatttgagagggaaaagtcatctcttgtatcatatattaaaactaccaataagaagagaaaggtcaatta
cggcgaaataaagaaaactgttcatggaggcactaatgcaaattacttttccggtaaaaagtctgacgagtatctgagtactacagttagatccaaca
ttaatcaaccttggatcaaaaccatctctaagaggatgagagttgatatcattaatcactctatagtaacgcgtggaaaaagctctatattacaaacta
tagaaattattttttactaatagaacatgtgtgaaaatattcaaggattctactatgcacattattctatccaaggacaaggatgaaaaggggtgtatac
acatgattgacaaattattctatgtctattataatttatttctgttgttcgaggatatcatccaaaacgagtactttaaagaagtagctaatgttgtaaacc
acgtactcacggctacggcattagatgagaaattattcctaattaagaaaatggctgaacacgatgtttatggagttagcaatttcaaaataggggatgt
ttaacctgacatttattaagtcgttggatcataccgttttcccctctctgttagatgaggatagcaaaataaagttttttaaggggaaaaagctcaatatt
gtagcattacgatctctggaggattgtataaattacgtgactaaatccgagaatatgatagaaatgatgaaggaaagatcgactattttaaatagcat
agatatagaaacggaatcggtagatcgtctaaaagaattgcttctaaaatga >Gene233:128732..132226, 3495 bp atgaaaaaaaacactgattcagaaatggatcaacgactcggatataagttttggtgcctgatcctaaagccggagtttttttatagaccgttacatttcc
aatatgtatcgtattctaatttttatattgcatcgattgcatgaaatcttgaccgtcaagcggccactcttatcgtttaagaataatacagaacgaattatg
atagaaattagcaatgttaaagtgactcctccagattactcacctataatcgcgagtattaaaggtaagagttatgacgcattagccacgttcactgta
aatatctttaaagaggtaatgaccaaagagggtatatccatcactaaaataagtagttatgagggaaaagattctcatttgataaaaattccgctacta
ataggatacgggaataaaaatccacttgatacagccaagtatcttgttcctaatgtcataggtggagtctttatcaataaacaatctgtcgaaaaagta
ggaattaatctagtagaaaagattacaacatggccaaaatttaggggttgttaagccaaactcattcactttctcgttttcctccgtatcccctcctaatgt
attaccgacaagatatcgccattacaagatatctctggatatatcacaattggaagcgttgaatatatcatcgacaaagacatttataacggtcaatat
tgttttgctgtctcaatatttatctagagtgagtctagaattcattagacgtagtttatcatacgatatgcctccagaagttgtctatctagtaaacgcgat
aatagatagtgctaaacgaattactgaatctattactgactttaatattgatacatacattaatgacctggtggaagctgaacacattaaacaaaaatc
tcagttaacgattaacgagttcaaatatgaaatgctgcataactttttacctcatatgaactatacacccgatcaactaaagggattttatatgatatctt
tactaagaaagtttctctactgtatcttccacacttctagatatccagatagagattcgatggtttgtcatcgcatcctaacgtacggcaaatattttgag
acgttggcacatgatgaattagagaattacataggcaacatccgaaacgatatcatgaacaatcacaagaacagaggcacttacgcggtaaacattc
atgtactaacaactcccggacttaatcacgcgtttttctagcttattgagtggaaagttcaaaaagtcagacggtagttatcgaacacatcctcactattc
atggatgcagaatatttctattcctaggagtgttggattttatccggatcaagtaaagatttcaaagatgttttctgtcagaaaataccatccaagtcaat
atctttactttttgttcatcagacgttccggaaagaggtcctcaggtaggtttagtatctcaattgtctgtcttgagttccattacaaatatactaacgtctg
agtatttggatttggaaaagaaaatttgtgagtatatcagatcatattataaagatgatataagttactttgaaacaggatttccaatcactatagaaa
atgctctagtcgcatctcttaatccaaatatgatatgtgattttgtaactgactttagacgtagaaaacggatgggattcttcggtaacttggaggtaggt
attactttagtttagggatcacatgaatgaaattcgcattaatattggagcgggaagattagtcagaccattcttggttgtggataacggagagctcatg

FIG. 13AU atggatgtgtgtccggagttagaaagcagattagacgacatgacattctctgacattcagaaagagtttccgcatgtcatcgaaatggtagatataga
acaatttacttttagtaacgtatgtgaatcggttcaaaaatttagaatgatgtcaaaggatgaaagaaagcaatacgatttatgtgactttcctgccga
atttagagatggatatgtggcatcttcattagtgggaatcaatcacaattctggacccagagctattcttggatgtgctcaagctaaacaagctatctctt
gtctgagttcggatatacgaaataaaatagacaatggaattcatttgatgtatccagagaggccaatcgtgattagtaaggctttagaaacttcaaag
attgcggctaattgcttcggccaacatgttactatagcattaatgtcgtacaaaggtatcaatcaagaggatggaattatcatcaaaaaacaatttattc
agagaggcggtctcgatatagttaccgcaaagaaacatcaagtagaaattccattggaaaactttaataacaaagaaagagataggtctaacgccta
ttcaaaattagaaagtaatggattagttagactgaatgctttcttggaatccggagacgctatggcacgaaatatctcatcaagaactcttgaagatga
ttttgctagagataatcagattagcttcgatgtttccgagaaatataccgatatgtacaaatctcgcgttgaacgagtacaagtagaacttactgacaa
agttaaggtacgagtattaaccatgaaagaaagaagacccattctaggagacaaatttaccactagaacgagtcaaaagggaacagtcgcgtatgt
cgcggatgaaacggaacttccatacgacgaaaatggtatcacgccagatgtcattattaattctacatccatcttctctagaaaaactatatctatgttg
atagaagttattttaacagccgcatattctgctaagccgtacaacaataagggagaaaaccgacctgtctgtttttcctagtagtaacgaaacatccatc
gatacatatgcaattcgctaaacaatgttatgagcattcaaatccgaaattgtctgatgaagaattatcggataaaatcttttgtgaaaagattctct
atgatcctgaaacggataagccttatgcatccaaagtatttttttggaccaatttattacttgcgtctgagacatttaactcaggacaaggcaaccgttag
atgtagaggtaaaaagacgaagctcattagacaggcgaatgagggacgaaaacgtggaggaggtatcaagttcggagaaatggagagagactgtt
taatagcgcatggcgcagccaatactattacagaagttttgaaagattcggaagaagattatcaagatgtgtatgtttgtgaaaattgtggagacata
gcagcacaaatcaagggtattaatacatgtcttagatgttcaaaacttaatctctctcctctcttaacaaaaattgataccacgcacgtatctaaagtat
ttcttactcaaatgaacgccagaggcgtaaaagtcaaattagatttcgaacgaagacctccttcgttttataaaccattagataaagttgatctcaagc
cgtcttttctggtgtaa >Gene234:131395..131616, 222 bp atggatgtttcgttactactaggaaaacagacaggtcggttttctcccttattgttgtacggcttagcagaatatgcggctgttaaaataacttctatcaa
catagatatagttttttctagagaagatggatgtagaattaataatgacatctggcgtgataccattttcgtcgtatggaagttccgtttcatccgcgacat
acgcgactgttcccttttga >Gene235:132231..132860, 630 bp atggaaacaatcaaagcgttggagaaatttatggagttcgatcgccttcagaaagactgctctgataaactcgatagagagagggagagacgcatga
aggctgaacgtgaaatcgctcgtaaaaactgcggaggtaacccatgcgaacgtgaattggaatctgaacgtagtaacgtgaagaggttggaatatca
actagatgcggagaaagaaaaagttaagttctacaaaagagaactagaacgtgatcggtatctttctagtagatatcttacctcttcttcagatccaca
tgagaaaccattaccaaattatacattttctcgcattaaaaatgtatctccgttgacaactgaggctacaggttctgtagaagtagcacctccatccaca
gacgttaccgaaccgattagtgatgtgacaccatcggtggatgccgaaccagaacatccacagctttctgaatatcagacttcagtatcccaagtagc
agttacacctccaccaaaacctgaaactccacagattttcgaatatcagacgtccgattctatagttaacaatccacgcccattttataattcggatctc
gaatttgatgatattgatatgtatctactaccaaactag >Gene236:133119..133280, 162 bp atggtggtagcaatggaaacatggaccaatacaaacgggaaattgaatctcttaaacgcgagctcgccgagtgtagacgtggtaacaatggatctca
cagtgattgcgcgtactatgacgaagaagcaagagaggaagttaagagctgactcaattgcatga >Gene237:133132..133815, 684 bp atgaaaccaatgctgaaacagagagagatgcgacgtcttagagatagaatctcagatattgaaagacagttgagtgactgcagacgtaataatgaa
agcaatgctgatatggaaagagagatgcaacgtcttagagatagaatcatggatcttgatagacagcttaacgagtgtaaacgcaacggtaacgga
acatcttctgaggaggtaaataggctaaagactagaatcaggaatcttaaacgatcgctagagatctgctcaaaggatgaatcagaactctattcagc
atataaaactaaactcggacgtgctagggaacaaattagtaacttgcaagaaagtctacgtagagagcgtgaatctgacaaaacagatagttactac
aggagggaattgactcgcgaaagaaataaaatcgtagaattggaaaaagaacttaataagtgtttcgatgccaagtacatcgacgaaatcaattcca
agaaaacccgtatttctgatctcgaacgacaactagcagcctgtaaatctaatggtggtagcaatggaaacatggaccaatacaaacgggaaattga

FIG. 13AV atctcttaaacgcgagctcgccgagtgtagacgtggtaacaatggatctcacagtgattgcgcgtactatgacgaagaagcaagagaggaagttaag
agctga >Gene238:133259..133432, 174 bp atgtttccattgctaccaccattagatttacaggctgctagttgtcgttcgagatcagaaatacgggtttcttggaattgatttcgtcgatgtacttggca
tcgaaacacttattaagttctttttccaattctacgattttatttctttcgcgagtcaattccctcctgtag >Gene239:133775..135952, 2178 bp atggaggtcacgaaccttattgaaaaatgtaccaagcactccaaagatttcgccactgaggtagaaaaactatggaacgatgagttgagttctgaatc
aggtctctcaagaaaaacaagaaatgtaattcgtaatattcttcgtgatatcactaagtcattaactacagataagaaatcaaagtgtttccgtatact
agaacgttcgacgattaacggagagcagattaaagatgtatataaaactatttttaataatggtgttgatgtggagtctagaatcaacactacaggaa
agtatgttctatttacagttatgacttatgttgctgctgaactacgtctcattaagtcagacgagatattcgctcttctattaagatttttaacatgatatg
tgatattcatagaaaatacggatgtggtaatatgtttgttggtattcccgctgctctaattaatctattggaaattgatcacattaacaaactgtttagcgt
gtttagtacaagatatgacgccaagacatacctatacactgaatattttcttttccttaacattaatcattatctacttagtggttcagatttatttatcaac
gtagcatatggtgctgtatcttttcgtcacccattagtgttccagattatatcatggaagcactgacatttaaggcatgtgatcatattatgaaatctgga
gatctaaaatatacatgcgtttactaaaaaggttaaggatctgtttaatactaaatctgattctatttatcaatacgttagacttcatgaaatgtcata
tgatggtgtttcagaagatacggatgatgacgatgaggtattcgctatccttaacttgagtattgattccagcgttgatagatacagaaacagagttctt
ctactaactcccgaagtcgcgtctcttagaaaagaatattctgaagtagaacccgattatataaatacttgatggatgaggaagtgcccgcgtacgacaa
gcatttgcctaagcctattactaacactggtattgaagaaccacacgctactggaggagatgaggaccaaccaattaaggttgtccatcccctaata
atgataaagatgatgctatcaagccatacaatccattagaagatcctaattatgttcccacaattacaagaacggctataggaatcgctgattaccaac
tagttattaataaactaattgaatggttagataaatgcgaggaagaatgcggaaatagtggagagtttaaaacagagttggaagaagccaagagaa
aactcaccgaattgaatgcagaacttagtgataaactcagtaagattaggactttggaaagggattctgtttataaaaccgaaagaatcgaccgactt
acaaaagagatcaaagaacacagggatattcaaaatgggacagatgatggttcagatttattagaaattgataagaagactatccgagaattgaga
gaatcgcttgatagggaacgagaaatgcgttcagaactagaaaaggaactggatactattaggaatggaaaagtagatggatcttgtcaacgagaa
cttgaactcagtcgtatgtggctaaaacaacgcgatgacgatctccgagctgaaatcgataaacgtcgtaatgtcgaatgggaactgtccagacttcgt
agggatatcaaggaatgcgacaaatacaaggaggatcttgataaggccaagacaactattagtaactacgtaagcaaaatcagtactctagaatca
gaaattgctaaatatcaacaagatagggacacgctttctgtagtacgcagagaacttgaggaagaacgacgacgcgttagagatctcgaatctagac
tcgatgaatgtacacgcaaccaggaagacacgcaagaagttgatgcactgcgttcgcgtattagagaactagagaataagttgaccaactgcatcga
gagcggaggaggaaatcttacagagattagcagactccaatctaaaatttcagatcttgaaagacaactgagtgaatgccgtgaaaatgctacagag
attagcagactccaatctagaatatcagatcttgaaagacagttgaacgactgtagacgtaataatgaaaccaatgctgaaacagagagagatgcga
cgtcttag >Gene240:135996..137504, 1509 bp atggcgaacattataaatttatggaacggaattgtaccaacggttcaagatgttaatgttgcgagcattactgcgtttaaatctatgatagatgaaacat
gggataaaaaaatcgaagcaaatacatgcatcagtagaaaacatagaaacattattcacgaagttattagggactttatgaaagcctatcctaaaat
ggatgagaataaaaaatctccattaggagccccaatgcaatggctaacacaatattatattttaaagaatgaatatcataagaccatgctagcgtatg
ataatggatcattgaatacaaaatttaaaacgttaaacatttatatgattactaacgttggtcaatatattttatatatagtattttgtataatatctggta
agaatcacgatggtactccttatatatacgattctgagataacgagcaatgataaaaattttattaatgagcgtatcaagtatgcatgtaagcaaatat
tacacggtcaattaactatagctctgagaattagaaataaattcatgtttataggatcacccatgtatttatggtttaacgtaaacggatcacaggtata
tcacgacatatatgatcgtaatgccggttttcataataaagagataggtagactactatacgcatttatgtactatctatctataagtggtagattttga
atgatttcgcactattaaagtttacgtatttaggagaatcctggacatttagtttgagtgtccctgaatatatattatatggtttaggatattctgtttttcga
tactattgaaaaatttagcaatgatgctatactcgtttatattagaacaaacaatagaaatggatatgattatgtagagtttaataaaaaaggaattgc
taaggtgacagaagataaacccgataacgataagcgaattcatgctataagactcatcaacgatagtactgatgttcaacacatacatttttgggttta
gaaatatggtaataatagacaatgaatgcgctaatattcagtcgagtgctgaaaatgcaactgatacaggacatcatcaagatagcaaaataaatat

FIG. 13AW cgaagtcgaagatgatgatgatgtcatagacgatgatgattataatccaaaacccactccgataccggagcctcaccctagaccaccgtttcccagac
atgaatatcataagaggccgaaacttcttcctgtagaagaacctgatcctgtcaaaaaagacgcggatcgtataagacttgataatcatatattaaac
acattggatcataatcttaatttcatcggacactattgttgtgatacagcggcagttgataggttagaacatcacatcgaaacattgggacaatatgca
gtaatactagcaagaaagataaatatgcaatcattactgttcccatggccattacctactgtccatccacatgcgatagatggtagtattccgccacatg
ggagatttacgatcttataa >Gene241:136224..136724, 501 bp atgattatcaagtcttatacgatccgcgtctttttgacaggatcaggttcttctacaggaagaagtttcggcctcttatgatattcatgtctgggaaacg
gtggtctagggtgaggctccggtatcggagtggggttttggattataatcatcatcgtctatgacatcatcatcatcttcgacttcgatatttattttgctatc
ttgatgatgtcctgtatcagttgcattttcagcactcgactgaatattagcgcattcattgtctattattaccatatttctaaacccaaaatgtatgtgttga
acatcagtactatcgttgatgagtcttatagcatgaattcgcttatcgttatcgggtttatcttctgtcaccttagcaattccttttttattaaactctacata
atcatatccatttctattgtttgttctaatataaacgagtatagcatcattgctaaattttttcaatagtatcgaaaacagaatatcctaa >Gene242:137554..137886, 333 bp atggacggaactcttttccccggagatgacgatcttgcaattccagcaactgaatttttttctacaaaggctgctaaaaagccagaggctaaacgcgaa
gcaattgttaaagccgatgaagacgacaatgaggaaactctcaaacaacggctaactaatttggaaaaaaagattactaatgtaacaacaaagtttg
aacaaatagaaaagtgttgtaaacgcaacgatgaagttctatttaggttggaaaatcacgctgaaactctaagagcggctatgatatctctggctaaa
aagattgatgttcagactggacggcgcccatatgagtaa >Gene243:137887..138327, 441 bp atgaactctctatcaatttttttttattgtggtagcgacggctgcggtgtgtttactttttatccagggttactcaatatatgaaaattatggcaatattaagg
aatttaatgctactcatgcagcattcgaatattcaaaatctataggtggaacaccggcattagataggagagttcaagatgtcaacgacacaatttctg
atgtaaagcaaaagtggagatgtgtggtttatccaggaaacggttttgtatccgcttccatatttggatttcaggcagaagttggacccaataatactag
atccattagaaaatttaacacgatgcaacaatgtatagactttacattttctgatgttattaacatcgatatttataatccatgtgttgtaccaaatataa
ataacgcagagtgtcagtttctaaaatctgtactttaa >Gene244:138328..139245, 918 bp atgcagcatccgcgggaagagaattcaatcgtcgttgaactcgaaccctcattggctacatttatcaaacaaggatttaataatctcgtaaaatggccc
ttgttaaacattggaatagttttgtctaatacatctaccgctgtcaatgaggaatggctaactgcggtagagcatattcccaccatgaagatattttaca
aacatatacataagatacttactagagaaatggggtttttagtctatttgaaaagatcccaatctgaacgcgataattatataactttatacgattttgat
tattatattatagataaggatacaaattctgtaactatggtagataaaccgaccgagttaaaggaaactttgttacatgtatttcaagaatatcgtttaa
agagttctcaaacaatagagcttatagcgtttagttcaggtacggtaataaacgaagacatagtttcaaaattaacatttttagatgtggaggtatttaa
tagagaatataataatgttaaaactatcatagatccggattttgtatttagatctccatttatagttatttctcctatgggtaaactaactttcttcgtagaa
gtatattcgtggtttgattttaaatcgtgtttcaaagatattatagatttcttagaaggtgctctaatagccaatattcataatcacatgattaaggtaggt
aattgtgacgaaacagtatcgtcttataatccagagtctggaatgttgtttgttaatgacttaatgactatgaacatagtcaactttttcggatgtaattct
aggttagaatcataccatcggttcgatatgacaaaagtagatgttgaactatttattaaagcattgtctgatgcgtgtaaaaaaattttgtcagcttcta
atagattataa >Gene245:139061..139273, 213 bp atggtgggaatatgctctaccgcagttagccattcctcattgacagcggtagatgtattagacaaaactattccaatgtttaacaagggccattttacga
gattattaaatccttgtttgataaatgtagccaatgagggttcgagttcaacgacgattgaattctcttcccgcggatgctgcatgatgaacgacgggat
gttgttcgattga >Gene246:139208..139441, 234 bp

FIG. 13AX atggaagaccttaacgaggcaaacttctcacatttattgataaatttatctaataataaagatatcgatgcgcaatacgcgtctacattatccgtggtac
atgaattgctatccgctataaattttaaaatatttaatataaacaaaaagtcgaaaaagaattccaaatcaatcgaacaacatcccgtcgttcatcatg
cagcatccgcgggaagagaattcaatcgtcgttga >Gene247:139601..139975, 375 bp atggcatctattttaaatacacttaggttttttggaaaaaacatcattttataattgtaacgattcaataactaaagaaaagattaagattaaacataagg
gaatgtcatttgtattttataagccaaagcattctaccgttgttaaatacttgtctggaggaggtatatatcatgatgatttggttgtattggggaaggta
acaattaatgatctaaagatgatgctattttacatggatttatcatatcatggagtgacaagtagtggagcaatttacaaattgggatcgtctatcgata
gactttctctaaataggactattgttacaaaagttaataattatgatgatacatttttttgacgacgatgattga >Gene248:139942..140754, 813 bp atgaattgtttccaagaaaaacaattttcaagagaaaatttattaaaaatgccgtttagaatggtttttaacgggaggatctggatctggaaaaactatc
tatttactatctctgttttctacactagttaaaaaatataaacatatattcttgtttacacccgtttataatccagattatgatggatacatttggccaaatc
atattaatttcgttagtagtcaggaatctctagaatataatctgatacgaactaaaagtaacatagaaaaatgtattgctgtcgcacaaaatcataaaa
aatcagcacacttttttacttattttttgatgatgtaggcgataaactatcaaaatgcaatactctaatagaattcttaaactttggaaggcatttaaacacg
tctattattctactatgccaaacttatagacacgtaccaatattaggacgggctaacattacgcatttttgtagttttaacatttccatctcagacgcgga
aaatatgctacgatcgatgcctgtaaaggggaaacgaaaggatatattaaacatgttgaatatgatacagaccgctagatccaataatcgattggcta
ttattatcgaagactccgtattttgtgaaggtgaattacgtatatgtaccgataccgctgataaggacgtcatagaacaaaagttaaacatcgatatttt
agtaaatcaatattcgcacatgaaaaagaatctaaacgctatattagaaagtaaaaaaacaaaattgtgcaatagcgatcaatcatcgtcgtcaaaa
aatgtatcatcataa >Gene249:140063..140329, 267 bp atgtttaacttttgttctatgacgtccttatcagcggtatcggtacatatacgtaattccacttcacaaaatacggagtcttcgataataatagccaatcg
attattggatctagcggtctgtatcatattcaacatgtttaatatatcctttcgtttccccttacaggcatcgatcgtagcatattttccgcgtctgagatg
gaaatgttaaaactacaaaaatgcgtaatgttagcccgtcctaatattggtacgtgtctataa >Gene250:140872..141429, 558 bp atgatgacaccagaaaacgacgaagagcagacatctgtgttctccgctactgtttacagagacaaaattcagggaaagaataaacgcaaacgcgtg
attggtctatgtattagaatatctatggttatttcactactatctatgattaccatgtccgcgtttctcatagtgcgcctaaatcaatgcatgtctgctaacg
aggctgctattactgacgccgctgttgccgttgctgctgcatcatctactcatagaaaggttgcgtctagcactacgcaatatgatcacaaagaaagct
gtaatggtttatattaccagggttcttgttatatattacattcagactaccagttattctcggatgctaaagcaaattgcactgcggaatcatcaacacta
cccaataaatccgatgtcttgactacctggctcattgattatgttaaggatacatggggatctgatggtaatccaattacaaaaactacatccgattatc
aagattctgatgtatcacaagaagttagaaagtattttttgtgttaaaacaatgaactaa >Gene251:141453..141959, 507 bp atgaaatcgcttaatagacaaactgtaagtaggtttaagaagttgtcggtgccggccgctataatgatgatactctcaaccattattagtggcatagga
acatttctgcattacaaagaagaactgatgcctagtgcttgcgccaatggatggatacaatacgataaacattgttatttagatactaacattaaaatgt
ctacagataatgcggtttatcagtgtcgtaaattacgagccagattgcctagaccggatactagacatctgagagtattgtttagtatttttttataaagat
tattgggtaagtttaaaaaagaccaatgataaatggttagatattaataatgataaagatatagatattagtaaattaacaaatttaaacaactaaac
agtacgacggatgctgaagcgtgttatatatacaagtctggaaaactggttaaaacagtatgtaaaagtactcaatctgtactatgtgttaaaaaattc
tacaagtga >Gene252:141933..142163, 231 bp

FIG. 13AY atgtcggaatattttatatcccgtacatctatttggacagtttttatgttacctataatgtatggtcctataaagtccatgattgagatatcgagatcatcat
acaatgtatctgttatagtcaacacacccattggagtaataacaaacgcggcgtccatggcggcgtacgttaacgacttattattaattcatttttttgttg
tcacttgtagaattttttaacacatag >Gene253:142003..142533, 531 bp atggacgccgcgtttgttattactccaatgggtgtgttgactataacagatacattgtatgatgatctcgatatctcaatcatggactttataggaccata
cattataggtaacataaaaactgtccaaatagatgtacgggatataaaatattccgacatgcaaaaatgctactttagctataagggtaaaatagttc
ctcaggattctaatgatttggctagattcaacatttatagcatttgtgccgcatacagatcaaaaaataccatcatcatagcatgcgactatgatatcat
gttagatatagaagataaacatcagccattttatctattcccatctattgatgttttttaacgctacaatcatagaagcgtataacctgtatacagctggag
attatcatctaatcatcaatccttcagataatctgaaaatgaaattgtcgtttaattcttcattctgcatatcagacggcaatggatggatcataattgat
gggaaatgcaatagtaattttttatcataa >Gene254:142600..143226, 627 bp atgatgctggtacctcttatcacggtgaccgtagttgcgggaacaatattagtatgttatatattatatatttgtaggaaaaagatacgtactgtctataa
tgacaataaaattatcatgacaaaattaaaaaagataaagagttctaattccagcaaatctagtaaatcaactgatagcgaatcagactgggaggat
cactgtagtgctatggaacaaaacaatgacgtagataatatttctaggaatgagatattggacgatgatagcttcgctggtagtttaatatgggataac
gaatccaatgttatggcgcctagcacagaacacatttacgatagtgttgctggaagcacgctgctaataaataatgatcgtaatgaacagactatttat
cagaacactacagtagtacttaatgaagataccaaacagaatcctaactattcatccaatcctttcgtaaattataataaaaccagtatttgtagcaag
tcaaatccgttcattacagaactcaacaataaatttagtgagaataatccgtttagacgagcacatagcgatgattatcttaataagcaagaacaaga
tcatgaacacgatgatatagaatcattggtgtga >Gene255:143239..143376, 138 bp atgttctgtatctatataatatctacagtcattattagcaataaaattgctaattttagaaatgccgaatacagggaatatctccatttgtacaacgtgac
ggcagcaataatactaaatattacttcaattttataa >Gene256:143290..144081, 792 bp atggagatattccctgtattcggcatttctaaaattagcaattttattgctaataatgactgtagatattatatagatacagaacatcaaaaaattatatc
tgatgagatcaatagacagatggatgaaacggtacttcttaccaacatcttaagcgtagaagttgtaaatgacaatgagatgtaccatcttattcctca
tagattatcgacgattatactctgtattagttctgtcggaggatgtgttatctctatagataatgacgtcaatggcaaaaatattctaacctttcccattga
tcatgctgtaatcatatccccactgagtaaatgtgtcgtagttagcaagggtcctacaaccatattggttgttaaagcggatatacctagcaaacgattg
gtaacatcgtttacaaacgacatactgtatgtaaacaatctatcactgattaattatttgccgttgtctgtattcattattagacgagttaccgactatttg
gatagacacatatgcgatcagatatttgcgaataataagtggtattccattataaccatcgacaataagcagtttcctattccatcaaactgtataggta
tgtcctctgccaagtacataaattctagcatcgagcaagatactttaatacatgtttgtaacctcgagcatccattcgacttagtatacaaaaaaatgca
gtcgtacaattctgtacctatcaaggaacaaatattgtacggtagaattgataatataaatatgagcattagtatttctgtggattaa >Gene257:143811..144062, 252 bp atgctcatatttatattatcaattctaccgtacaatatttgttccttgataggtacagaattgtacgactgcattttttttgtatactaagtcgaatggatgct
cgaggttacaaacatgtattaaagtatcttgctcgatgctagaatttatgtacttggcagaggacatacctatacagtttgatggaataggaaactgctt
attgtcgatggttataatggaataccacttattattcgcaaatatctga >Gene258:144171..144344, 174 bp atggattcattctcttctctttttatgaaactctgttgtatatctactgataaaactggaagcaaaaaatctgataaaaagaataagaataagatcaagg
attattataaaataacaatagttcctggttcctcttccacgtctactagctcgtggtattatacacatgcctag

FIG. 13AZ

>Gene259:144341..145174, 834 bp atgtcaagagttagaatatcgttgatatacctctatacgttggttgttataacaactacaaagaccatagagtatacagcatgtaatgataccatcatta
ttccgtgtactatagataatccgacaaagtatattagatggaaattggataaccatgatattttaacttataataaaacttccaagacgacaatattaag
taaatggcatactagtgctagacttcattcgttatcagatagtgatgtctcattgattatggaatataaagatatcttaccaggtacttatacatgcgggg
ataatactggaataaaatctactgtgaaattagttcaacttcatactaattggtttaatgattaccaaacaatgttgatgtttatctttacgggcattactt
tattcttattatttctcgagatcacttatacatcgatatccgttgtattttctactaatttaggaatcttacaagtatttggttgtgttattgccatgatagag
ttatgcggagcattttttgttttatccgtcaatgtttactctccggcatattattggattgttgatgatgacgttaccatctatatttcttataattactaaagt
attttcattttggttactgtgtaaattatcatgcgctgtacacctcattatctactatcaattggccggatacattttaacggttttgggtttgggattgagtt
taaaggaatgtgttgatggtactctgttattatctgggttgggaactattatggtgtctgaacattttagcctgttatttctagtctgctttccgtcaacgca
aagagactattactag >Gene260:145191..145442, 252 bp atgataccttttgttatttattttattctattttgctaacggtattgaatggcataagtttgaaacgagtgaagaaataatttctacttacttattagacgacg
tattatacacgggtgttaatggggcggtatacacattttcaaataataaactaaacaaaactggtttaactaataataattatataacaacatctataa
aagtagaggatgcggaaccaataacggaaatcccaaatgttggaaaatag >Gene261:145748..146380, 633 bp atgtgcctaaacgacgaaggtggtccatcatcattgtctagtcatagatggtcgacgtttctcaaagtcgaattagaatgtgatatcgacggaagaagt
tatagacaaattattcattctagaactataaaaacagataatgatacgatactatatgtattcttcgatagtccttattccaagtccgcattatgtaccta
ttctatgaataccattaaacaatctttttctacgtcaaaattggaaggatatacaaagcaattgccgtctccagctcctggtatatgtttaccagctggaa
aagttgttccacataccacgtttgaagtcatagaaaaatataatgtactagatgatattataaagcctttatctaaccaacctatcttcgaaggaccgtc
tggtgttaaatggttcgatataaaggagaaggaaaatgaacatcgggaatatagaatatacttcataaaagaaaattctatatattcgttcgatacaa
aatctaaacaaactcgtagctcgcaagtcgatgcgcgactattttcagtaatggtaacttcgaaaccgttatttatagcagatataggatagagtag
gaatgccacaaatgaaaaaaatacttaaaatgtaa >Gene262:145945..146214, 270 bp atgaagtatattctatattcccgatgttcattttccttctcctttatatcgaaccatttaacaccagacggtccttcgaagataggttggttagataaaggc
tttataatatcatctagtacattatattttctatgacttcaaacgtggtatgtggaacaacttttccagctggtaaacatataccaggagctggagacgg
caattgctttgtatatccttccaattttgacgtagaaaaagattgtttaatggtattcatagaatag >Gene263:146406..146651, 246 bp atgaacaaacataagacagattatgctggttatgcttgctgcgtaatatgcggtctaattgttggaattatttttacagcgacactattaaaagttgtag
aacgtaaattagttcatacaccatcaatagataaaacgataaaagatgcatatattagagaagattgtcctactgactggataagctataataataaa
tgtatccatttatctactgatcgaaaaaacctgggaggaaggacgtaa >Gene264:146984..147643, 660 bp atgtactcgttattatttattattttgatgtgtataccatttagttttcaaacagtgtatgatgataaatcggtatgcgattctgacaataaagaatatatg
ggaatcgaagtttacgtagaagcaacactagacgaacacctcagacaaacaacgtgtgaatccgaaatccataaatatggcgcatctgtatcaaacg
gaggattaaatatttctgttgatttattaaactgttttcttaattttcatacagttggtgtatacactaatcgcgataccgtatacgcgaagtttgctagttt
ggatccatggactacggaacctataaattctatgacccatgacgatctagtaaaattaacagaagaatgtatagtggacatttatttaaaatgtgaagt
ggataaaacaaaggatttcatgaaaactaatggcaatagattaaaaccaagagactttaaaactgttcctccttctgatgtaggaagcatgatagaac
tacagtctgactattgcgtaaacgatgtgactgcatacgtcaaaatatacgatgagtgcggaaacattaaacagcattccattccaacactaagagat
tattttaccaccaagaatggtcaaccacgtaaaatattaaagaaaaaatttgataattgttaa

FIG. 13BA

>Gene265:147808..148209, 402 bp 144 atggctgaatggcataaaattatcgaggatatctcaaaaaataataagttcgaggatgccgccatcgttgattacaagactacaaagaatgttctagc
tgctattcctaacagaacatttgccaagattaatccgggtgaaattattcctctcatcactaatcgtaatattctaaaacctcttattggtcagaaatattg
tattgtatatactaactctctaatggatgagaacacgtatgctatggagttgcttactgggtacgcccctgtatctccgatcgttatagcgagaactcata
ccgcacttatattttgatgggtaagccaacaacatccagacgtgatgtgtatagaacgtgtagagatcacgctacccgtgtacgcgcaactggtaatt
aa >Gene266:148247..148831, 585 bp atgatgatgatgaaatggataatatccatattgacgatgtcaataatgccggtattggcatacagctcatcgattttttagatttcattcagaggatgtgg
aattatgttatgggcatttgtattttgataggatctataatgtagtaaatataaaatataatccgcatattccatatagatataattttattaatcgcacgt
taaccgtagatgaactagacgataatgtcttttttacacatggttatttttttaaaacacaaatatggttcacttaatcctagtttgattgtctcattatcag
gaaacttaaaatataatgatatacaatgctcagtaaatgtatcgtgtctcattaaaaatttggcaacgagtacatctactatattaacatctaaacataa
gacttattctctacatcggtccacgtgtattactataataggatacgattctattatatggtataaagatataaatgacaagtataatgacatctatgatt
ttactgcaatatgtatgctaatagcgtctacattgatagtgaccatatacgtgtttaaaaaaataaaaatgaactcttaa >Gene267:148839..149075, 237 bp atgctattagaaatggataaaatcaaaattacggttgattcaaaaattggtaatgttgttaccatatcgtataacttggaaaagataactattgatgtta
cacctaaaaagaaaaaagaaaggatgtattattagcgcaatcagttgctgtcgaagaggcaaaagatgtcaaggtagaagaaaaaaatattatcg
atattgaagatgacgatgatatggatgtagaaagcgcataa >Gene268:149171..150211, 1041 bp atggccgtgtacgcggttactggtggtgccggatttctaggcaggtatatagtaaaactgttaattagtgcagatgatgttcaagaaatcagagtcata
gatattgtagaagatccacaaccaataacctcgaaagttaaggttataaactatatacaatgtgatataaacgactttgataaggtgagagaagcgct
agatggggtaaatctgattattcatacggctgctctagtggatgtatttggaaaatacaccgataatgaaatcatgaaagtaaactattatggaacaca
gactatattggcagcttgtgtggacctaggaatcaagtatttgatctatactagtagcatggaagcaataggacccaataaacacggtgatccattcat
cggccatgagcatacccctttatgatatatcaccaggacatgtatacgcaaaaagtaaacgtatggccgagcaactggttatgaaagccaataattccg
taatcatgaatggagcaaaattgtatacttgttgcctaagacccactggaatttacggagaaggagacaaattgacgaaagtcttttacgagcaatgt
aagcaacacggtaacattatgtatcgtacagtcgatgatgacgcggtgcatagccgggtatatgtaggaaatgctgcatggatgcacgtgttggctgc
aaaatatatccagtatccgggatctaagattaaaggaaatgcttacttttgctacgattactctccatcgtgttcgtacgatatgtttaatcttctattgat
gaaaccattgggaatagaacaaggatctagaattccaagatggatgctaaaaatgtacgcgtgcaagaatgatatgaagagaattctatttagaaaa
ccatcactactcaacaactatacgttgaagatatccaacactacatttgaggtgcgtaccaacaatgcagaactagatttcaactactcccctatcttta
acgtcgatgtggcattcgaacgaacacggaaatggctagaagaatcagaataa >Gene269:150258..150635, 378 bp atggctgtttgtataatagaccacgataatatcagaggagttatttactttgaaccagtccatggaaaagataaagttttaggatcagttattggattaa
aatccggaacgtatagtttgataattcatcgttacggagatattagtcaaggatgtgattccataggcagtccagaaatatttatcggtaacatctttgt
aaacagatatggtgtagcatatgtttatttagatacagatgtaaatatatttacaattattggaaaggcgttatctatttcaaaaaatgatcagagatta
gcgtgtggagttattggtatttcttacataaatgaaaagataatacattttcttacaattaacgagaatggcgtttga >Gene270:150625..151347, 723 bp atggccgtttgatatatcagttaatgcgtctaaaacaataaatgcattagtttactttctactcagcaaaataaattagtcatacgtaatgaagttaatga
tacacactacactgtcgaatttgatagggacaaagtagttgacacgtttatttcatataatagacataatgacaccatagagataagaggggtgcttcc

FIG. 13BB agaggaaactaatattggttgcgcggttaatacgccggttagtatgacttacttgtataataagtatagttttaaactgattttagcagaatatataaga
cacagaaatactatatccggcaatatttattcggcattgatgacactagatgatttggctattaaacagtatggagacattgatctattatttaatgaga
aacttaaagtagactccgattcgggactatttgactttgtcaactttgtaaaggatatgatatgttgtgattctagaatagtagtagctctatctagtcta
gtatctaaacattgggaattgacaaataaaaagtataggtgtatggcattagccgaacatatatctgatagtattccaatatctgagctatctagacta
cgatacaatctatgtaagtatctacgcggacacactgagagcatagaggatgaatttgattattttgaagacgatgattcgtctacatgttctgccgtaa
ccgacagggaaacggatgtataa >Gene271:150951..151268, 318 bp atgctctcagtgtgtccgcgtagatacttacatagattgtatcgtagtctagatagctcagatattggaatactatcagatatatgttcggctaatgccat
acacctatactttttatttgtcaattcccaatgtttagatactagactagatagagctactactattctagaatcacaacatatcatatcctttacaaagtt
gacaaagtcaaatagtcccgaatcggagtctactttaagtttctcattaaataatagatcaatgtctccatactgtttaatagccaaatcatctagtgtca
tcaatgccgaataa >Gene272:151435..152169, 735 bp atgggtaacaaaaatattaaaccatctaaggaaaatagactgtccatcttgtccaaggataagatggattcatttaagagaggatcttgggcaacgtc
atcctttaaagaaaagtcgcgtgcaaccatccaaagattttcatctcttagacgagaacatattaaagtagaccatcctgacaagttcctggagttaaa
gagagggatatatgaaataattcagaaatcgtcgtctatagatgtggacaaacggactaagctcatgtccaacataaaaacgatgatgataaatcca
ttcatgatcgagggtttaatgacatctttagaaaacttggatcccgataacaagatgagctactcatcagtgatgatattgggagaattcgacatcatc
aatataagcgacaatgaggcggcgttcgagttcataaacagtctgttgaaatctcttctcttgttaaatactagacaactaaaactcttggaatactcca
ttagtaatgacttgttgtatgcccacataaatgcgttggagtatatcataaaaaatacatttaatgttccagaacggcaactgattctgagaggtcaata
cctaactccaattttcagtgatttgttaaagtatgcgggtctaaccataaagtcaaacatacttatgtggaataaacagtttatcaaaccagtatctgac
ctctatacatctataagactcctttattgtgttacagtataa >Gene273:151628..151816, 189 bp atgatatactccaacgcatttatgtgggcatacaacaagtcattactaatggagtattccaagagtttagttgtctagtatttaacaagagaagagatt
tcaacagactgtttatgaactcgaacgccgcctcattgtcgcttatattgatgatgtcgaattctcccaatatcatcactgatgagtag >Gene274:152042..152203, 162 bp atggttgcacgcgacttttcttaaaggatgacgttgcccaagatcctctcttaaatgaatccatcttatccttggacaagatggacagtctattttcctta
gatggtttaatattttgttacccatgatctataaaggtagacctaatcgtctcggatga >Gene275:152162..152341, 180 bp atgatgttcatacattgtgttgtttttccagatttgtccaatccttcaaaaacgattaatgccccacgagacatttttgtaaacctaacatattttttacaat
ttatgcgtataataaaactgaaaataaatatatggtcatccgagacgattaggtctacctttatagatcatgggtaa >Gene276:152268..152882, 615 bp atgtctcgtggggcattaatcgtttttgaaggattggacaaatctggaaaaacaacacaatgtatgaacatcatggaatctataccggcaaacacgat
aaaatatcttaactttcctcagagatccactgtcactggaaagatgatagatgactatctaactcgtaaaaaaacctataatgatcatatagttaatcta
ttattttgtgcaaatagatgggagtttgcatcttttatacaagaacaactagaacagggaattactttaatagttgatagatacgcattttctggagtagc
gtatgccgccgctaaaggcgcgtcaatgactctcagtaagagttatgaatctggattgcctaaacccgacttagttatattcttggaatctggtagcaaa
gaaattaatagaaacgtcggcgaggaaatttatgaagatgttacattccaacaaaaggtattacaagaatataaaaaaatgattgaagaaggagat
attcattggcaaattatttcttctgaattcgaggaagatgtaaagaaggagttgattaagaatatagttatagaggctatacacacggttactggacca
gtggggcaactgtggatgtaa

FIG. 13BC

>Gene277:152930..153418, 489 bp atggatgaagcatattactctggcaacttggaatcagtactcggatacgtgtccgatatgcataccgaactcgcatcaatatctcaattagttattgcca
agatagaaactatagataatgatatattaaacaaggacattgtaaattttatcatgtgtagatcaaacttggataatccatttatctctttcctagatact
gtatatactattatagatcaagagatctatcagaccgaattgattaattcattagacgacaatgaaattatcgattgtatagttaacaagtttatgagctt
ttataaggataacctagaaaatatagtagatgctatcattactctaaaatatataatgaataatccagattttaaaactacgtatgccgaagtactcggt
tccagaatagccgatatagatattaaacaagtgatacgtaagaatatactacaattgtctaatgatatccgcgaacgatatttgtga >Gene278:153451..155109, 1659 bp atgacgtcgcttcgcgaatttagaaaattatgctgtgatatatatcacgcatcaggatataaagaaaaatctaaattaattagagactttataacagat
agggatgataaatatttgatcattaagctattgcttcccggattagacgatagaatttataacatgaacgataaacaaattataaaattatatagtata
atatttaaacaatctcaggaagatatgctacaagatttaggatacggatatataggagacactattaggactttcttcaaagagaacacagaaatccg
tccacgagataaaagcattttaactttagaagaagtggatagttttttaactacgttatcatccgtaactaaagaatcgcatcaaataaaattattgact
gatgtagcatctgtttgtacatgtaatgatttaaaatgtgtagtcatgcttattgataaagatctaaaaattaaagcgggccctcggtacgtacttaacg
ctattagtcctcatgcctatgatgtgtgtttagaaaatctaataacttgaaagagataatagaaaatgcatctaaacaaaatctagactctatatctatttct
gttatgactccaattaatcccatgttagcggaatcgtgtgattctgtcaataaggcgtttaaaaaatttccatcaggaatgtttgcggaagtcaaatacg
atggtgaaagagtacaagttcataaaaataataacgagtttgccttctttagtagaaacatgaaaccagtactctctcataaagtggattatctcaaag
aatacataccgaaagcatttaaaaaagctacgtctatcgtattggattctgaaattgttcttgtagacgaacataatgtaccgctaccgtttggaagttt
aggaatacacaaaaagaaagaatataaaaactctaacatgtgtttgttcgtgtttgactgtttgtactttgatggattcgatatgacggacattccattg
tacgaacgaagatctttctcaaagatgttatggttgaaatacccaatagaatagtattctcagagttgacgaatattagtaacgagtctcagttaactg
acgtattggatgatgcactaacgagaaaattagaaggattggtcttaaaagatattaatggagtatacgaaccgggaaagagaagatggttaaaaat
aaagcgagactatttgaacgagggttccatggcagattctgccgatttagtagtactaggtgcctactatggtaaaggagcaaagggtggtatcatgg
cagtctttctaatgggttgttacgacgatgaatccggtaaatggaagacggttaccaagtgttcaggacacgatgataatacgttaagggagttgcaa
gaccaattaaagatgattaaaattaacaaggatcccaaaaaaattccagagtggttagtagttaataaaatctatattcccgattttgtagtagaggat
ccgaaacaatctcagatatgggaaatttcaggagcagagtttacatcttccaagtcccataccgcaaatggaatatccattagatttcctagatttacta
ggataagagaggataaaacgtggaaagaatctactcatctaaacgatttagtaaacttgactaaatcttaa >Gene279:154120..154320, 201 bp atgttcgtctacaagaacaatttcagaatccaatacgatagacgtagctttttaaatgctttcggtatgtattctttgagataatccactttatgagaga
gtactggtttcatgtttctactaaagaaggcaaactcgttattatttttatgaacttgtactctttcaccatcgtatttgacttccgcaaacattcctga >Gene280:154236..154439, 204 bp atgtccgtcatatcgaatccatcaaagtacaaacagtcaaacacgaacaaacacatgttagagttttttatattctttcttttgtgtattcctaaacttcca
aacggtagcggtacattatgttcgtctacaagaacaatttcagaatccaatacgatagacgtagctttttaaatgctttcggtatgtattctttgagata
a >Gene281:155162..156166, 1005 bp atggatggtgttattgtatactgtctaaacgcgttagtaaaacatggcgaggaaataaatcatataaaaaatgatttcatgattaaaccatgttgtgaa
agagtttgtgaaaaagtcaagaacgttcacattggcggacaatctaaaaacaatacagtgattgcagatttgccatatatggataatgcggtatccga
tgtatgcaattcactgtataaaaagaatgtatcaagaatatccagatttgctaatttgataaagatagatgacgatgacaagactcctactggtgtata
taattattttaaacctaaagatgttattcctgttatcatatctataggaaaggataaagatgtctgtgaactattaatctcatcagacatatcgtgtgcat
gcgtggagttaaattcatatcacgtagccattcttcccatgaatgtttcctttttttaccaaaggaaatgcctcgttgattattctcctgtttgatttctctatc
gatgcagcacctctcttaagaagtgtaaccgataataatgttattatatctagacaccagcgtctcacatgacgagcttccgagttccaattggttcaagt
tttacataagtataaagtccgactattgttctatattatatatggttgttgatggatctgtgatgcatgcgatagctgataatagaactcacgcaattatta

FIG. 13BD gcaaaaatatattagacaatactacaattaacgatgagtgtagatgctgttattttgaaccacagattaggattcttgatagagatgagatgctcaatg
gatcatcgtgtgatatgaacagacattgtattatgatgaatttacctgatgtaggcgaatttggatctagtatgttggggaaatatgaacctgacatgat
taagattgctctttcggtggctggtaatttaataagaaatcgagactacattcccgggagacgaggctatagctactacgtttacggtatagcctctaga
taa >Gene282:156236..156808, 573 bp atggacataaagatagatattagtatttctggtgataaatttacggtgactactaggagggaaaatgaagaaagaaaaaaatatctacctctccaaa
aagaaaaaactactgatgttatcaaacctgattatcttgagtacgatgacttgttagatagagatgagatgtttactattctagaggaatattttatgta
cagaggtctattaggcctcagaataaaatatggacgactctttaacgaaattaaaaaattcgacaatgatgcggaagaacaattcggtactatagaa
gaactcaagcagaaacttagattaaattctgaagagggagcagataactttatagattatataaaggtacaaaaacaggatatcgtcaaacttactgt
atacgattgcatatctatgataggattgtgtgcatgcgtggtagatgtttggagaaatgagaaactgttttctagatggaaatattgtttacgagcgatt
aaactgtttattaatgatcacatgcttgataagataaaatctatactgcagaatagactagtatatgtggaaatgtcatag >Gene283:156943..157266, 324 bp atgacccgttggtggcggagtaggtatatctgccgtagccaatgtagtaatgtaaaaaatagtacatgcagtcagcaaattctttatatccatcttttaa
tattatcatatactacaataacaaaatcttttttttaaaacgttaaaccaccatcaaaaatccatgtttaaagttatcagattaaaatatatttttcgaaatt
aatagctgtatatcttatccatcaattttagatttatatattttcgaaattaatagctgtatatctcatccatcaatttttagatttatatgttttgaaaaacac
tatcttactcatactctag >Gene284:157158..157556, 399 bp atgataatattaaaagatggatataaagaatttgctgactgcatgtactattttttacattactacattggctacggcagatatacctactccgccacca
acgggtcatgtgacaagggagaatatcttgataagaggcataatcaatgttgtaatcggtgtccacctggagaatttgccaaggttagatgtaatggt
aacgataacacaaaatgtgaacgctgcccacctcatacatataccacaatccccaattattctaatggatgtcatcaatgtagaaaatgcccaaccgg
atcatttgataaggtaaagtgtaccggaacacagaacagtaaatgttcgtgtcttcctggttggtattgcgctactgattcttcacagactgaagattgtt
ga >Gene285:157174..157470, 297 bp atggatataaagaatttgctgactgcatgtactattttttacattactacattggctacggcagatatacctactccgccaccaacgggtcatgtgacaa
gggagaatatcttgataagaggcataatcaatgttgtaatcggtgtccacctggagaatttgccaaggttagatgtaatggtaacgataacacaaaat
gtgaacgctgcccacctcatacatataccacaatccccaattattctaatggatgtcatcaatgtagaaaatgcccaaccggatcatttgataaggtaa >Gene286:157606..157785, 180 bp atgaacaaggaaatcctatttgtaaatcgtgctgtattggtgaatattgcaactacctacgtaattatagacttgatccattttctccatgcaaactatct
aaatgtaattaattatgattttgatgataatgttaccatacattatatcgctacttggttagtgtattattcagtatga >Gene287:157975..159669, 1695 bp atgaatagcagcagtaaattaattgctgttattaatggatttagaaatagtggacgattttgtgatattaatatagttattaatgatgaaaggatanaacg
ctcacagactcatcctatctggagcctccgaatattttccattctgttttccaataattttatcgattctaatgaatacgaagttaatctaagtcatttaga
ttatcaaagtgttaacgatttgatcgattacatttatgggataccttgagcctaactaacgataacgtgaaatatattctttcaaccgctgattttttaca
aattggatctgccattactgagtgcgaaaaatacatacttaaaaatctttgttctagaaactgtatcgatttctacatatacgctgataaatataataac
aagaaaatagaatcagcgtcgtttaacacaatattacgaaatattttgagactcatcaacgatgaaaactttaaatacttaacagaggaatcaatgat
aaaaattttaagcgatgatatgttaaatataaaaaatgaggattttgcaccactaattctcattaaatggttagagagtactcaacaatcatgcaccgt
cgagttacttagatgcctcagaatatcattgctttccccacaagttataaaatcactttatagtcatcaactggttagttcaatctacgaatgtataacatt
cttaaacaatatagcattcttggatgaatcatttcctagataccatagcatcgagttgatatctatcggtataagtaattcgcatgataagatttccataa

FIG. 13BE actgctacaatcataaaaaaaatacatgggaaatgatatcttcacgtagatataggtgtagtttcgcagtggccgtcctggataatattatctatatgat
gggtggatatgatcagtccccgtatagaagttcaaaggttatagcgtacaatacatgtacaaattcttggatatatgatataccagagctaaaatatcc
tcgttctaattgtgggggactggctgatgacgaatacatttattgtataggcggcatacgcgatcaggattcatcgttgacatctagtattgatagatgg
aagccatcaaaaccatattggcagaagtatgctaaaatgcgcgaaccaaaatgtgatatggggggttgcgatgttaaacggattaatatatgtcatggg
tggaatcgttaaaggtgacacgtgtaccgacgcactagagagtttatcagaagatggatggatgaagcatcaacgtcttccaataaaaatgtccaata
tgtcgacgattgttcatgatggcaagatttatatatctggaggttacaacaatagtagtgtagttaatgtaatatcgaatctagtccttagctataatccg
atatatgatgaatggaccaaattatcatcattaaacattcctagaattaatcccgctctatggtcagcgcataataaattatatgtaggaggaggaata
tctgatgatgttcgaactaatacatctgaaacatacgataaagaaaaagattgttggacattggataatggtcacgtgttaccacgcaattatataatg
tataaatgcgaaccgattaaacataaatatccattggaaaaaacacagtacacgaatgattttctaaagtatttggaaagtttttataggtagttga >Gene288:159719..160666, 948 bp atgacacgattaccaatacttttgttactaatatcattagtatacgctacacctttttcctcagacatctaaaaaaataggtgatgatgcaactctatcatg
taatcgaaataatacaaatgactacgttgttatgagtgcttggtataaggagcccaattccattattcttttagctgctaaaagcgacgtcttgtattttg
ataattataccaaggataaaatatcttacgactctccatacgatgatctagttacaactatcacaattaaatcattgactgctagagatgccggtactta
tgtatgtgcattctttatgacatcaactacaaatgacactgataaagtagattatgaagaatactccacagagttgattgtaaatacagatagtgaatc
gactatagacataatactatctggatctacacattcaccagaaactagttctgagaaaccagaggatatagataattttaattgctcgtcggtattcga
aatcgcgactccggaaccaattactgataatgtagaagatcatacagacaccgtcacatacactagtgatagcattaatacagtaagtgcatcatctg
gagaatccacaacagacgagactccggaaccaattactgataaagaagaagatcatacagtcacagacactgtctcatacactacagtaagtacatc
atctggaattgtcactactaaatcaaccaccgatgatgcggatctttatgatacgtacaatgataatgatacagtaccaccaactactgtaggcggtag
tacaacctctattagcaattataaaaccaaggactttgtagaaatatttggtattaccgcattaattatattgtcggccgtggcaatattctgtattacat
attatatatataataaacgttcacgtaaatacaaaacagagaacaaagtctag >Gene289:160608..160745, 138 bp atggctgtctttcctgaaccagatggtccgctcaatatgatagattttactatcccagacatttatgtaagtcaaaaatctagactttgttctctgttttgta
tttacgtgaacgtttattatatatataatatgtaa >Gene290:160811..161266, 456 bp atggaacgagaaggtgtcgattaccattacgttaacagagaggccatctggaagggaatagccgccggaaactttctagaacatactgagtttttagg
aaatatttacggaacttctaaaactgctgtgaatacagcggctattaataatcgtatttgtgtgatggatctaaacatcgatggcgttagaagtcttaaa
aatacgtacctaatgccttactcggtgtatataagacctacctctcttaaaatggttgagaccaagcttcgttgtagaaacactgaagcggatgatgag
attcatcgtcgtgtgatgttggcaaaaactgacatggatgaggcaggtgaagccggtctattcgacactattatcattgaagatgatgtgaatttagcat
atagtaagttaattcagatactacaggaccgtattagaatgtattttaacactaattag >Gene291:161417..162319, 903 bp atgaactttcaaggacttgtgttaactgacaattgcaaaaatcaatgggtcgttggaccattaataggaaaaggtggattcggtagtatttatactacta
atgacaataattatgtagtaaaaatagagcccaaagctaacggatcattatttaccgaacaggcattttatactagagtacttaaaccatccgttatcg
aagaatggaaaaaatctcacaatataaagcacgtaggtcttatcacgtgcaaggcatttggtctatacaaatccattaatgtggaatatcgattcttgg
taattaatagattaggtgcagatctagatgcggtgatcagagccaataataatagattaccaaaaaggtcggtgatgttgatcggaatcgaaatctta
aataccatacaatttatgcacgagcaaggatattctcacggagatattaaagcgagtaatatagtcttggatcaaatagataagaataaaattatatcta
gtggattacggattggtttctaaattcatgtctaatggcgaacatgttccatttataagaaatccaaataaaatggataacggtactctagaatttacac
ctatagattcgcataaaggatacgttgtatctagacgtggagatctagaaacacttggatattgtatgattagatggttgggaggtatcttgccatggac
taagatatctgaaacaaagaattgtgcattagtaagtgccacaaaacagaaatatgttaacaatactgcgactttgttaatgaccagtttgcaatatgc
acctagagaattgctgcaatatattaccatggtaaactctttgacatattttgaggaacccaattacgacgagtttcggcacatattaatgcagggtgta
tattattaa

FIG. 13BF

>Gene292:161632..161820, 189 bp atggtatttaagatttcgattccgatcaacatcaccgacctttttggtaatctattattattggctctgatcaccgcatctagatctgcacctaatctattaa
ttaccaagaatcgatattccacattaatggatttgtatagaccaaatgccttgcacgtgataagacctacgtgctttatattgtga >Gene293:161917..162240, 324 bp atggtaatatattgcagcaattctctaggtgcatattgcaaactggtcattaacaaagtcgcagtattgttaacatatttctgttttgtggcacttactaat
gcacaattctttgtttcagatatcttagtccatggcaagatacctcccaaccatctaatcatacaatatccaagtgtttctagatctccacgtctagatac
aacgtatcctttatgcgaatctataggtgtaaattctagagtaccgttatccattttatttggatttcttataaatggaacatgttcgccattagacatgaa
tttagaaaccaatccgtaa >Gene294:162409..163068, 660 bp atggcgatgttttacgcacacgctctcggtgggtacgacgagaatcttcatgcctttcctggaatatcatcgactgttgccaatgatgtcaggaaatatt
ctgttgtgtcagtttataataacaagtatgacattgtaaaagacaaatatatgtggtgttacagtcaggtgaacaagagatatattggagcactgctgc
ctatgtttgagtgcaatgaatatctacaaattggagatccgatccatgatcaagaaggaaatcaaatctctatcatcacatatcgccacaaaaactact
atgctctaagcggaatcgggtacgagagtctagacttgtgtttggaaggagtagggattcatcatcacgtacttgaaacaggaaacgctgtatatgga
aaagttcaacatgattattctactatcaaagagaaggccaaagaaatgaatgcactcagttcaggacctatcatcgattaccacgtctggataggaga
ttgtatctgtcaagttactgctgtggacgtacatggaaaggaaattatgagaatgagattcaaaaagggtgcggtgctacagatcccaaatctggtaa
aagttaaacttggggagaatgatacagaaaatctttcttctactatatcggcggcaccatcgaggtaa >Gene295:162912..163199, 288 bp atgcgtatgcacataacagcattctttaccattcacaatatcaaaatgatcatatacaacagaccacatatggcgtatagtttccaaacgtttcatgagt
acattattcacgcggtcttcttgagaggtggttacctcgatggtgccgccgatatagtagaagaaagattttctgtatcattctccccaagtttaacttta
ccagatttgggatctgtagcaccgcacccttttgaatctcattctcataatttcctttccatgtacgtccacagcagtaacttga >Gene296:163104..163478, 375 bp atgaaacgtttggaaactatacgccatatgtggtctgttgtatatgatcattttgatattgtgaatggtaaagaatgctgttatgtgcatacgcattcatct
aatcaaaatcctataccgagtactgtaaaaacaaatttgtacatgaagactatgggatcatgcattcaaatggattccatggaagctctagagtatctt
agcgaactgaaggaatcaggtggatggagtcccagaccagaaatgcaggaatttgaatatccagatggagtggaagacactgaatcaattgagaga
ttggtagaggagttcttcaatagatcagaacttcaggctggtaaattagtcaaatttggtaattctattaattgttaa >Gene297:164137..165813, 1677 bp atggatttttttaaaaaggaaatacttgactggagtgtatatttatctcttcattatatagcacgcgtgtgttccaattcttccacatcccatataatacag
gattataatctcgttcgaacatacgagaaagtggataaaacaatagttgattttttatctaggttgccaaatttattccatattttagaatatggggaaa
atattctacatatttattctatggatgatgctaatacgaatattataattttttttctagatagagtattaaatattaataagaacgggtcatttatacaca
atctcaggttatcatcatccattaatataaaagaatatgtatatcaattagttaataatgatcatccagataataggataagactaatgcttgaaaatgg
acgtagaacaagacatttttttgtcctatatatcgatacagttaatatctatatatgtattttaataaatcatggatttatatagatgcagaagacagtt
acggttgtacattattacatagatgtatatatcactataagaaatcagaatcagaatcatacaatgaattaattaagatattgttaaataatggatccg
atgtagataaaaaagatacgtacggaaacacacctttatcctattatgtaaacacgatatcaacaacgtggaattgtttgagatatgtttagagaatg
ctaatatagactctgtagacttaatagatatacacctcttcattatgtctcatgtcgtaataaatatgattttgtaaagttattaatttctaaaggagcaa
atgttaatgcgcgtaataaattcggaactactccattttattgtggaattatacacggtatctcgcttataaaactatatttggaatcagacacagagtta
gaaatagataatgaacatatagttcgtcatttaataattttttgatgctgttgaatctttagattatctattatccagaggagttattgatattaactatcgt
actatatacaacgaaacatctatttacgacgctgtcagttataatgcgtataatacgttggtctatctattaaacagaaatggtgattttgagacgatta
ctactagtggatgtacatgtatttcggaagcagtcgcaaacaacaacaaaataataatggaagtactattgtctaaacgaccatctttgaaaattatga

FIG. 13BG tacagtctatgatagcaattactaaaaataaacaacataatgcagatttattgaaaatgtgtataaaatatactgcgtgtatgaccgattatgatactct
tatagatgtacagtcgctacagcaatatataaatggtatattttaaaatgtttcgatgaaatagatatcatgaagagatgttatataaaaaataaaactgt
attccaattagtttttttgtatcaaagacattaatactttaatgagatatggtaaacatccttctttcgtgaagtgcactagtctcgacgtatacggaagtc
gtgtacgtaatatcatagcatcattagatatcgtcagagattaattagtctattatccaagaagctggatgcgggagataaatggtcgtgttttcctaa
cgaaataaaatataaaatattggaaaactttaacgataacgaactatccacatatctaaaaatcttataa >Gene298:164147..164260, 114 bp atgttcgaacgagattataatcctgtattatatgggatgtggaagaattggaacacacgcgtgctatataatgaagagataaatatacactccagtca
agtatttccttttttaa >Gene299:165917..166870, 954 bp atgaaaacgatttccgttgttacgttgttatgcgtactacctgctgttgtttattcaacatgtactgtacccactatgaataacgctaaattaacgtctacc
gaaacatcgtttaatgataaacagaaagttacatttacatgtgatcagggatatcattctttggatccaaatgctgtctgcgaaacagataaatggaaa
tacgaaaatccatgcaagaaaatgtgcacagtttctgattatgtctctgaattatatgataagccattatacgaagtgaattccaccatgacactaagtt
gcaacggcgaaacaaaatattttcgttgcgaagaaaaaaatggaaatacttcttggaatgatactgttacgtgtcctaatgcggaatgtcaacctcttc
aattagaacacggatcgtgtcaaccagttaaagaaaaatactcatttggggaatatatgactatcaactgtgatgttggatatgaggttattggtgcttc
gtacataagttgtacagctaattcttggaatgttattccatcatgtcaacaaaaatgtgatataccgtctctatctaatggattaatttccggatctacatt
ttctatcggtggcgttatacatcttagttgtaaaagtggttttatactaacgggatctccatcatccacatgtatcgacggtaaatggaatcccatactcc
caacatgtgtacgatctaacgaaaaatttgatccagtggatgatggtcccgacgatgagacagatttgagcaaactctcgaaagacgttgtacaatat
gaacaagaaatagaatcgttagaagcaacttatcatataatcatagtggcgttaacaattatgggcgtcatatttttaatctccgttatagtattagtttg
ttcctgtgacaaaaataatgaccaatataagttccataaattgctaccgtaa >Gene300:166953..167474, 522 bp atgtcttcttcagtggatgttgatatctacgatgccgttagagcatttttactcaggcactattataacaagagatttattgtgtatggaagaagtaacgc
catattacataatatatacaggctatttacaagatgcgccgttataccgttcgatgatatagtacgtactatgccaaatgaatcacgtgttaaacaatgg
gtgatggatacacttaatggtataatgatgaatgaacgcgatgtttctgtaagcgttggcaccggaatactattcatggaaatgttttcgattacaata
aaaatagtatcaacaatcaactaatgtatgatataattaatagcgtatctataattctagctaatgagagatatagaagcgctttaacgacgatggta
tatacatccgtagaaatatgattaacaagttgtacggatacgcatctctaactactattggcacgatcgctggaggtgtttgttattatctgttgatgcat
ctagttagtttgtataaataa >Gene301:167015..167230, 216 bp atgaatagtattccggtgccaacgcttacagaaacatcgcgttcattcatcattataccattaagtgtatccatcacccattgtttaacacgtgattcattt
ggcatagtacgtactatatcatcgaacggtataacggcgcatcttgtaaatagcctgtatatattatgtaatatggcgttacttcttccatacacaataa
atctcttgttataa >Gene302:167512..168060, 549 bp atgtataaaaaactaataacgttttttatttgtaataggtgcattagcatcctattcgaataatgagtacactccgtttaataaaactgagtgtaaaactcta
tatagatggagtagataatatagaaaattcatatactgatgataataatgaattggtgttaaattttaaagagtacacaatttctattattacagagtca
tgcgacgtcggatttgattccatagatatagatgttataaacgactataaaattattgatatgtataccattgactcgtctactattcaacgcagaggtca
cacgtgtagaatatctaccaaattatcatgccattatgataagtacccttatattcacaaatatgatggtgatgagcaacaatattctattactgcagag
ggaaaatgctataaaggaataaaatatgaaataagtatgatcaacgatgatactctattgagaaaacatactcttaaaattggatctacttatatattt
gatcgtcatggacatagtaatacatattattcaaaatatgattttttaa >Gene303:168115..168933, 819 bp

FIG. 13BH atgagatatattataattctcgcagttttgttcattaatagtatacacgctaaaataactagttataagtttgaatccgtcaattttgattccaaaattgaa
tggactggggatggtctatacaatatatcccttaaaaattatggcatcaagacgtggcaaacaatgtatacaaatgtaccagaaggaacatacgacat
atccgcatttccaaagaatgatttcgtatctttctgggttaaatttgaacaaggcgattataaagtggaagagtattgtacgggactatgcgtcgaagta
aaaattggaccaccgactgtaacattgactgaatacgacgaccatatcaatttgtacatcgagcatccgtatgctactagaggtagcaaaaagattcc
tatttacaaacgcggtgacatgtgtgatatctacttgttgtatacggctaacttcacattcggagattctaaagaaccagtaccatatgatatcgatgact
acgattgcacgtctacaggttgcagcatagactttgtcacaacagaaaaagtgtgcgtgacagcacagggagccacagaagggtttctcgaaaaaat
tactccatggagttcgaaagtatgtctgacacctaaaaagagtgtatatacatgcgcaattagatccaaagaagatgttcccaatttcaaggacaaaa
tggccagagttatcaagagaaatttaataaacagtctcaatcttatttaactaaatttctcggtagcacatcaaatgatgttaccacttttcttagcatg
cttaacttgactaaatattcataa >Gene304:168227..168415, 189 bp atggtctatacaatatatcccttaaaaattatggcatcaagacgtggcaaacaatgtatacaaatgtaccagaaggaacatacgacatatccgcattt
ccaaagaatgatttcgtatctttctgggttaaatttgaacaaggcgattataaagtggaagagtattgtacgggactatgcgtcgaagtaa >Gene305:169005..169178, 174 bp atgaacactgcaatcagttctttcgggatagaaatctttggcaattatacacaaccctattttcaatccccatgtttcctcttcagtcttctcacatcgtcta
atagacatggagtagatgatagaggggaacagaaggactataatcagggacctcatcttgaaaatggttag >Gene306:169020..169253, 234 bp atgaggtccctgattatagtccttctgttcccctctatcatctactccatgtctattagacgatgtgagaagactgaagaggaaacatggggattgaaaa
tagggttgtgtataattgccaaagatttctatcccgaaagaactgattgcagtgttcatctcccaactgcaagtgaaggattgataactgaaggcaatg
gattcagggatatacgaaacaccgataaattataa >Gene307:169216..169716, 501 bp atggattcagggatatacgaaacaccgataaattataaaaaaaagcaatgtgtccgctgtttccgttaataatactattttcgtaactggcggattattca
taaataactctaatagcacgatcgtggttaacaatatggaaaaacttgacatttataaagacaaacaatggtcgattatagaaatgcctatggctagg
gtatatcacggcatcgactcgacatttggaatgttatattttgccggaggtctatccgttaccgaacaatatggtaatttagagaaaaacaacgagata
tcttgttacaatcctagaacgaataagtggtttgatatttcatatactatttataagatatccatatcatcattgtgtaaactaaataacgtcttctatgtat
ttagtaaggacattggatatgtggaaaagtatgatggtgcatggaagttagtacatgatcgtctccccgctataaaggcattatcaacttctccttattg
a >Gene308:170073..170924, 852 bp atggaatccttcaagtattgttttgataacgatggcaagaaatggattatcggaaatactttatattctggtaattcaatactatataaggtcagaaaaa
atttcactagttcgttctacaattacgtaatgaaaatagatcacaaatcacacaagccattgttgtctgaaatacgattctatatatctgtattggatcctt
tgactatcgacaactggacacgggaacgtggtataaagtatttggctattccagatctgtatggaattggagaaaccgatgattatatgttcttcgttat
aaagaattcgggaagagtattcgccccaaaggatactgaatcagtcttcgaagcatgcgtcactatgataaacacgttagagtttatacactctcgag
gatttacccatggaaaaatagaaccgaggaatatactgattagaaataaacgtctttcactaattgactattctagaactaacaaactatacaagagt
ggaaactcacatatagattacaacgaggacatgataacttcaggaaatatcaattatatgtgtgtagacaatcatcttggagcaacagtttcaaaacg
aggagatttagaaatgttgggatattgcatgatagaatggttcggtggcaaacttccatggaaaaacgaaagtagtataaaagtaataaaacaaaaa
aaagaatataaaaaatttatagctactttctttgaggactgttttcctgaaggaaatgaacctctggaattagttagatatatagaattagtatacacgt
tagattattctcaaactcctaattatgacagactacgtaaactgtttatacaagattga >Gene309:171022..172059, 1038 bp

FIG. 13BI atggatatcttcagggaaatcgcatcttctatgaaaggagagaatgtattcatttctccagcgtcaatctcgtcagtattgacaatactgtattatggag
ctaatggatccactgctgaacagctatcaaaatatgtagaaacggaggagaacacggataaggttagcgctcagaatatctcattcaaatccatgaat
aaagtatatgggcgatattctgccgtgtttaaagattcctttttgagaaaaattggcgataagtttcaaactgttgacttcactgattgtcgcactataga
tgcaatcaacaagtgtgtagatatctttactgaggggaaaatcaatccactattggatgaaccattgtctcctgatacctgtctcctagcaattagtgcc
gtatactttaaagcaaaatggttgatgccattcgaaaaggaatttaccagtgattatcccttttacgtatctccgacggaaatggtagatgtaagtatga
tgtctatgtacggcaaggcatttaatcacgcatctgtaaaggaatcattcggcaactttcaatcatagaactgccatatgttggagatactagtatgat
ggtcattcttccagacaagattgatggattagaatccatagaacaaaatctaacagatacaaattttaagaaatggtgtaactctctggaagctacgtt
tatcgatgttcacattcccaagtttaaggtaacaggttcgtataatcttgtggatactctagtaaagtcaggactgacagaggtgttcggttcaactgga
gattatagcaatatgtgtaattcagatgtgagtgtcgacgctatgattcacaaaacgtatatagatgtcaatgaagagtatacagaagcagctgcagc
aacttgtgcactggtgtcagactgtgcatcaacaattacaaatgagttctgtgtagatcatccgttcatctatgtgattaggcatgttgatggaaaaattc
ttttcgttggtagatattgctctccgacaactaattgttaa >Gene310:172135..172584, 450 bp atgacggccaactttagtacccacgtcttttcaccacagcactgtggatgtgacagactgaccagtattgatgacgtcagacaatgtttgactgaatata
tttattggtcgtcctatgcataccgcaacaggcaatgcgctggacagttgtattccacactcctctcttttagagatgatgcggaatcagtgttcatcgac
attcgcgagctggtaaaaaatatgccgtgggatgatgtcaaagattgtacagaaatcatccgttgttatataccggatgagcaaaaaaccatcagaga
gatttcggccatcatcggactttgtgcatatgctgctacttactggggaggtgaagaccatcccactagtaacagtctgaacgcattgtttgtgatgcttg
agatgctcaattacgtggattataacatcatattccggcgtatgaattga >Gene311:172321..172596, 276 bp atgtacaactcatcaattcatacgccggaatatgatgttataatccacgtaattgagcatctcaagcatcacaaacaatgcgttcagactgttactagtg
ggatggtcttcacctcccagtaagtagcagcatatgcacaaagtccgatgatggccgaaatctctctgatggttttttgctcatccggtatataacaac
ggatgatttctgtacaatctttgacatcatcccacggcatattttttaccagctcgcgaatgtcgatgaacactga >Gene312:172697..173677, 981 bp atgagtatactacctattatatttcttcctatattttttattcttcattcgttcagacttttaacgcgcctgaatgtatcgacaaagggcaatattttgcatc
attcatggagttagaaaacgagccagtaatcttaccatgtcctcaaataaatacgctatcatccggatataatatattagatattttatgggaaaaacg
aggagcggataatgatagaattataccgatagataatggtagcaatatgctaattctgaacccgacacaatcagactctggtatttatatatgcattac
cacgaacgaaacctactgtgacatgatgtcgttaaatttgacaatcgtgtctgtctcagaatcaaatatagatcttatctcgtatccacaaatagtaaat
gagagatctactggcgaaatggtatgtcccaatattaatgcatttattgctagtaacgtaaacgcagatattatatggagcggacatcgacgccttaga
aataagagacttaaacaacggacacctggaattattaccatagaagatgttagaaaaaatgatgctggttattatacatgtgttttagaatatatatac
agaggtaaaacatataacgtaaccagaattgtaaaattagaggtacgggataaaataataaccttctactatgcaattaccagatggcattgtaacttc
aataggtagtaatttgactattgcgtgtagagtatcgttgagacctcccacaacggatgcagacgtcttttggataagtaatggtatgtattacgaaga
agatgatgggacggagacggtagaataagtgtagcaaataaaatctatatgaccgataagagacgtgttattacatcccggttaaacattaatcctg
tcaaggaagaagatgctacaacgtttacgtgtatggcgtttactattcctagcatcagcaaaacagttactgttagtataacgtga >Gene313:173011..173238, 228 bp atggtaataattccaggtgtccgttgtttaagtctcttatttctaaggcgtcgatgtccgctccatataatatctgcgtttacgttactagcaataaatgca
ttaatattgggacataccatttcgccagtagatctctcatttactatttgtggatacgagataagatctatatttgattctgagacagacacgattgtcaa
atttaacgacatcatgtcacagtag >Gene314:173723..174745, 1023 bp atgtctagaaagtttatgcaggtgtatgaatatgacagagagcaatatctcgatgagttcattgaagacagatataacgatagtttttatcactagtcca
gaatactatagtgcggaaaaatacatgtgtagatatactacactaaatcacaattgtataaacgtacgacgatgcgcgttagactccaagttattacat

FIG. 13BJ gatatcataaccaattgtaaaatatataacaatatagaattagttagggcgacaaaatttgtttattatctggatctgataaaatgtaattgggtatcta
aggtaggtgattcagttctatatcccgttatatttataacacatacaagtactagaaatttagataaagtctctgtaaaaacatacaagggcgttaaagt
aaaaaaacttaatagatgcgcggatcatgctattgtaattaatccattcgtcaagtttaaactaacgttgccgaacaaaacaagtcatgcaaaggtatt
ggttacattttgtaagttaagaacggatataacgcagatagaggcaccgctttcgggcaatgtttttagtttatacatttcctgacattaataaaagaatt
cctggatatatacatgtcaacatagaaggatgtatcgatggaatgatttatataaattcttcaaagttcgcgtgtgttttaaaactacatagatcaatgt
atcgcattccacccctttcctatagatatctgctcttgttgttcacaatatactaacgatgacatagaaattcccattcatgatttaataaaggatgtggca
attttttaaaaataaggagacggtatattatctaaaattaaataataaaactatagctagatttacgtactttaataatatagataccgcaattacacaa
gaacatgagtatgtcaaaatagcactaggtatagtctgcaagttaatgattaataaatatgcatagtatcgtgggagttaatcatagcaatacgttcgtc
aattgtttgttggaagataatgtataa >Gene315:173973..174101, 129 bp atgggaatttctatgtcatcgttagtatattgtgaacaacaagagcagatatctataggaaagggtggaatgcgatacattgatctatgtagttttaaaa
cacacgcgaactttgaagaatttatataa >Gene316:174885..176609, 1725 bp atgagtcgtcgtctgatttatgttttaaatatcaaccgcaaatcaactcataaaatacaagagaatgaaatatatacatattttagtcattgcaatatag
accatacttctacagaacttgattttgtagttaaaaactatgatctaaacagacgacaacatgtaactgggtatactgcactacactgctatttgtataa
taattactttacaaacgatgtactgaagatattattaaatcatgacgtaaatgtaacgatgaaaaccagtagcggacgtatgcctgtttatatattgctt
actagatgttgcaatatttcacatgatgtagtgatagatatgatagacaaagataaaaaccacttattacatagagactattccaacctattactagag
tatataaaatctcgttacatgttattaaaggaagaggatatcgatgagaacatagtatccactttattagataagggaatcgatcctaactttaaacaa
gacggatatacagcgttacattattattatttgtgtctcgcacacgtttataaaccaggtgagtgtagaaaaccgataacgataaaaaaggccaagcg
aattatttctttgtttatacaacatggagctaatctaaacgcgttagataattgtggtaatacaccattccatttgtatcttagtattgaaatgtgtaataa
tattcatatgactaaaatgctgttgacttttaatccgaatttcaaaatatgtaataatcatggattaacgcctatactatgttatataacttccgactacat
acaacacgatattcttgttatgttaatacatcactatgaaacaaatgttggagaaatgccgatagatgagcgtcgtatgatcgtattcgagtttatcaaa
acatattctacacgtccggcagattcgataacttatttgatgaataggtttaaaaatataaatatttatacccgctatgaaggaaagacattattcacg
tagcatgtgaatataataatacacacgtaatagattatcttatacgtatcaacggagatataaatgcgttaaccgacaataacaaacacgctacacaa
ctcattatagataacaaagaaattccccgtataccatcgattgtttactgtatatacttagatatattgtagataagaatgtgataagatcgttggtgg
atcaacttccatctctacctatcttcgatataaaatcatttgagaaattcatatcctactgtatactttttagatgacacattttacgataggcacgttaaga
atcgcgattctaaaacgtatcgatacgcatttttcaaaatacatgtcgtttgataaatacgatggtataataactaaatgtcacgacgaaacaatgttact
caaactgtccactgttctagacactacactatatgcagttttaagatgccataattcgaaaaagttaagaagatacctcaacgagttaaaaaaaatata
ataacgataagtcctttaaaatatattctaatattatgaatgagagataccttaatgtatattataaagatatgtacgtgtcaaaggtatatgataaact
atttcctgttttcacagataaaaaattgtctactaacattactaccttcagaaattatatacgaaatattatacatgctgacaattaacgatctttataatat
atcgtatccacctaccaaagtatag >Gene317:176681..177736, 1056 bp atgacgatgaaaatgatggtacatatatatttcgtatcattattgttattgctattccacagttacgccatagacatcgaaaatgaaatcacagaattctt
caataaaatgagagatactctaccagctaaagactctaaatggttgaatccagcatgtatgttcggaggcacaatgaatgatatagccgctctaggag
agccattcagcgcaaagtgtcctcctattgaagacagtctttatcgcacagatataaagactatgtggttaaatgggagaggctagaaaagaataga
cggcgacaggtttctaataaacgtgttaaacatggtgatttatggatagccaactatacatctcaaattcagtaaccgtaggtatttgtgtaccgtaacta
caaagaatggtgactgtgttcagggtatagttagatctcatattaaaaaacctccttcatgcattccaaaaacatatgaactaggtactcatgataagt
atggcatagacttatactgtggaattctttacgcaaaacattataataatataacttggtataaagataataaggaaattaatatcgacgacattaagt
attcacaaacgggaaagaaattaattattcataatccagagttagaagatagtggaagatacaactgttacgttcattacgacgacgttagaatcaag
aatgatatcgtagtatcaagatgtaaaatacttacggttataccgtcgcaagaccacaggtttaaactaatactagatccaaaaatcaacgtaacgat
aggagaacctgccaatataacatgcactgctgtgtcaacgtcattattgattgacgatgtactgattgaatgggaaaatccatccggatggcttatagg

FIG. 13BK attcgattttgatgtatactctgtttttaactagtagaggcggtattaccgaggcgaccttgtactttgaaaatgttactgaagaatatataggtaatacat
ataaatgtcgtggacacaactattattttgaaaaaacccttacaactacagtagtattggagtaa >Gene318:178468..179424, 957 bp atggaaatgtatcctcgtcatagatatagtaagcattctgtctctttaagggattttctgacaaagttagaaaaaatgatttagacatgaatgtggtaaaa
gaattactttctaacggtgcatctctaacaattaaggatagcagtaataaggatccaataaccgtttattttcgaagaacgataatgaatttagaaatg
attgatattattaacaaacatacaactattgatgaacgaaagtatatagtacactcctatctaaaaaattataaaaatttcgattatccattttttcagga
agttagttttgactaataaacattgtctcaacaattattataatataagcgacagcaaatatggaacaccgctacatatattggcgtctaataaaaaatt
aataactcctaattacatgaagttattagtgtataacggaaatgatataaacgcacgaggtgaagatacacaaatgcgaactccattacacaaatatt
tgtgtaaatttgtatatcataatattgaatatggtatccgatactataatgaaaagattatagacgcatttatagagttaggagccgatctaactattcca
aataacgatggaatgataccagtagtttactgtatacactcaaatgcagaatatggttataacaatattactaacataaagataatacgtaaactactt
aatcttagtagacgtgcgtcacataatctatttagagatcgagtcatgcacgattatataagtaatacatatattgatcttgagtgtttagatattattag
atcgttggatggattcgatatcaatggttactttgaaggacgtacaccacttcattgcgctatacaacataacttcactcagattgctaagtacttattag
atcgaggagctgatatagtcgtacccaacacattgattatacatcagtacatacagtaa >Gene319:179436..179840, 405 bp atggaggaggatacaaatatttcaaataaagttataaggtacaacactgtcaataatatatggaagacattacctaacttctggactggaactataaa
tccaggcgtggtctcgcataaagatgatatatatgttgtatgcgacatcaaagatgaaaaaaatgttaagacttgtatatttagatataacacgaatac
gtataacggatgggaattggttacgacgacagaaagcagattatcagctctgcatactattcttcatgacaataccataatgatgttacattgttatgaa
tcgtatatgttacaagatacatttaatgtgtacactcgcgaatggaatcatatgtgtcatcaacattcgaatagttatatcatgtacaatatactacccat
ctactaa >Gene320:180114..181187, 1074 bp atggatatctttaaagaactaatcttaaaacaccctgatgaaaatgttttgatttctccagtttctattttatctactttatctattctaaatcatggagcag
ctggttctacagctgaacaactatcaaaatatatagagaatatgaatgagaatacacccgatgataagaaggatgacaataatgacatggacgtaga
tattccgtattgtgcgacactagctaccgcaaatataaatatacggtagcgatagtatcgagttccacgcctccttcctacaaaaaataaaagacgattt
tcaaactgtaaactttaataatgctaaccaaacaaaggaactaatcaacgaatgggttaagacgatgacaaatggtaaaattaattccttattgacta
gtccgctatccattaatactcgtatgacagttgttagcgccgtccattttaaagcaatgtggaaatatccattttctaaacatcttacatatacagacaag
ttttatatttctaagaatatagttaccagtgttgatatgatggtgggtaccgagaataacttgcaatatgtacatattaatgaattattcggaggattctct
attatcgatattccatacgagggaaactctagtatggtaattatactaccggacgacatagaaggtatatataacatagaaaaaaatataacagatga
aaaatttaaaaaatggtgtggtatgttatctactaaaagtatagacttgtatatgccaaagtttaaagtggaaatgacagaaccgtataatctggtacc
gattttagaaaatttaggacttactaatatattcggatattatgcagatttttagcaagatgtgtaatgaaactatcactgtagaaaaaatttctacatacg
acgtttatagatgttaatgaggagtatacagaagcatcggccgttacaggagtatttatgactaacttttcgatggtatatcgtacgaaggtctacataa
accatccattcatgtacatgattaaagacaacacaggacgtatacttttttatagggaaatactgctatccgcaataa >Gene321:180516..180686, 171 bp atgtacatattgcaagttattctcggtacccaccatcatatcaacactggtaactatattcttagaaatataaaacttgtctgtatatgtaagatgtttag
aaaatggatatttccacattgctttaaaatggacggcgctaacaactgtcatacgagtattaatggatag >Gene322:181349..181921, 573 bp Atgatgatatacggattaatagcgtgtcttatattcgtgacttcatccatcgctagtccactttatattcccgttattccacccattacggaagataaatcg
ttcaatagtgtagaggtattagtttccttgtttagagatgaccaaaaagactatacggtaacttctcagttcaataactacactatcgataccaaagact
ggactatcggcgtactatccacacctgatggtttggatataccattgactaatataacttattggtcacggtttactataggtcgtgcattgttcaaatca
gagtctgaggatattttccaaaagaaaatgagtattctaggtgtttctatagaatgtaagaagtcgtcgacattacttactttttttgaccgtgcgtaaaat

FIG. 13BL gactcgagtatttaataaatttccagatatggcttattatcgaggagactgtttaaaagccgtttatgtaacaatgacttataaaaatactaaaactgga
gagactgattacacgtacctctctaatggggggttgcctgcatactatcgtaatggggtcgatggttga

FIG. 14A

>Protein 1:266..541, 91 aa

MSLESFIITTFNNNSSTNIDNMCHLYVKVCPSSLLFRLFVECCDINKLVEGTTPLHCYLMNEGFESSVLKNLLKEYVMNTF
NVHDIHYTNI

>Protein 2:880..1425, 181 aa

MISLSFLIHNPLKKWKLKPSISINGYRSTFTMASPCAQFRPCHCHATKDSLNTVADVRHCLTEYILWVSHRWTHRESAGS
LYRLLISFRTDATELFGGELKDSLPWDNIDNCVEIIKCFIRNDSMKTAEELRAIIGLCTQSAIVSGRVFNDKYIDILLMLRKIL
NENDYLTLLDHIRTAKY

>Protein 3:1472..2455, 327 aa

MIAFIIFREIGIISTRIAMDCTCILCRLLDEDVTYKKIKLEIETCHNLSKHIDRRGNNALHCYVFNKCDTDIKIVRLLLSRGVERL
CRNNEGLTPLGAYSKHRYVKSQIVHLLISSYSNSSNELKSNINDFDLYSYMSSDNIDLRLLKYLIVDKRIRPSKNTNYAINGL
GLVDIYVTTPNPRPEVLLWLLKSECYSTGYVFRTCMYDSDMCKNSLHYYISSHRESQSLSKDVIKCLINNNVSIHGRDEGG
SLPIQYYWSCSTIDIEIVKLLIKDVDTCRVYDVSPILEADYLNKRFRVTPYNVDMEIVNLLIERRHTLVDVMRSITS

>Protein 4:2922..3251, 109 aa

MLFYLEEPIRGYVIILIVHPSWNDCATGHILIMLLNWHEQKEEGQHLLYLFIKHNQGYTLNILRYLLDRFDIQKDEYYNTAF
QNCNNNVASYIGYDINLPTKDGIRLGV

>Protein 5:3266..4021, 251 aa

MSRINITKKIYCSVFFHIFNYEKVNHYEMDEIVRIVRDSMWYIPNVFMDDGKNEGHVSVNNVCHMYFTFFDVDTSSHL
FKLVIKHCDLNKRGNSPLHCYTMNTRFNPSVLKILLHHGMRNFDSKDEKGHIPLHHYLIHSLSIDNKIFDILTDTIDDFSKSS
DLLLCYLRYKFNGSLNYYVLYKGSDPNCVDEDGLTSLHYYCKHISTFYKSNYYKLSHTKMRAEKRFIYAIIDYGANINAVTH
LPSTVYQT

>Protein 6:4209..4631, 140 aa

MSMKYLMLLFAAMIIRSFADSGNAIETTSPEITNATTDIPAIRLCGPEGDGYCLHGDCIHARDIDGMYCRCSHGYTGIRC
QHVVLVDYQRSENPNTTTSYIPSPGIMLVLVGIIIITCCLLSVYRFTRRTKLPIQDMVVP

>Protein 7:4786..5781, 331 aa

MDIYDDKGLQTIKLFNNEFDCIRNDIRELFKHVTDSDSIQLPMEDNSDIIENIRKILYRRLKNVECVDIDSTITFMKYDPND
DNKRTCSNWVPLTNNYMEYCLVIYLETPICGGKIKLYHPTGNIKSDKDIMFAKTLDFKSKKVLTGRKTIAVLDISVSYNRS
MTTIHYNDDVDIDIHTDKNGKELCYCYITIDDHYLVDVETIGVIVNRSGKCLLVNNHLGIGIVKDKRISDSFGDVCMDTIF
DFSEARELFSLTNDDNRNIAWDTDKLDDDTDIWTPVTEDDYKFLSRLVLYAKSQSDTVFDYYVLTGDTEPPTVFIFKVTR
FYFNMPK

>Protein 8:6293..6847, 184 aa

MEFDPAKINTSSIDHVTILQYIDEPNDIRLTVCIIRNINNITYYINITKINTHLANQFRAWKKRIAGRDYMTNLSRDTGIQQS
KLTETIRNCQKNRNIYGLYIHYNLVINVVIDWITDVIVQSILRGLVNWYIANNTYTPNTPNNTTTISELDIIKILDKYEDVYRV
SKEKECGICYEVVYSKR

>Protein 9:6822..7010, 62 aa

MKLFTQNDRYFGLLDSCTHIFCITCINIWHKTRRETGASDNCPICRTRFRNITMSKFYKLVN

FIG. 14B

>Protein 10:7176..7556, 126 aa

MRILFLIAFMYGCVHPYVNADEIKCPNLNIVTSSGEFRCTGCVKFMPNFSYMYWLAKDMRSDEDAKFIEHLGEGIKEDE
TVSTIDGRIVTLQKVLHVTDTNKFDNYRFTCVLTTIDGVSKKNIWLK

>Protein 11:7615..8328, 237 aa

MSYACPILSTINICLPYLKDINMIDKRGETLLHKAVRYNKQSLVSLLLESGSDVNIRSNNGYTCIAIAINESRNIELLKMLLCH
KPTLDCVIDSLREISNIVDNYYAIKQCIKYAMIIDDCTSSKIPESISQRYNDYIDLCNQELNEMKKIMVGGNTMFSLIFTDH
GAKIIHRYANNPELREYYELKQNKIYVEAYDIISDAIVKHDRIHKTIESVDDNTYISNLPYTIKYKIFEQQ

>Protein 12:8417..8830, 137 aa

MKGIDNTAYSYIDDLTCCTRVIMADYLNSDYRYNKDVDLDLVKLFLENGKPHGIMCSIVPLWRNDKETIFLILKTMNSDV
LQHILIEYMTFGDIPLVEYGTVVNKEAIHEYFRNINIDSYTMKYLLKKEGRCHQLSR

>Protein 13:8935..9093, 52 aa

MAAVFFMRTSTDTRMMIINYEIAVPYCICISSLICIQSRIREHMCVRKLLNV

>Protein 14:9097..9330, 77 aa

MLKLKDIAMALLEATGFSNINDFNIFSYMKSKNVDVDLIKVLVEHGFDLSVKCENHRSVIENYVMTMILFLKLLICS

>Protein 15:9352..9567, 71 aa

MFDYLENEEVALDELKQMLRDRDPNDTRNQFKNNALHAYLFNEHCNNVEVVKLLLDSGTNPLRKNWRQLPH

>Protein 16:10049..11953, 634 aa

MVNDKILYDSCKTFNIDASSAQSLIESGANPLYEYDGETPLKAYVTKKNNNIKNDVVILLLSSVDYKNINDFDIFEYLCSDNI
DIDLLKLLISKGIEINSIKNGINIVEKYATTSNPNVDVFKLLLDKGIPTCSNIQYGYKIKIEQIRRAGEYYNWDDELDDYDYDY
TTDYDDRMGKTVLYYYIITRSQDGYATSLDVINYLISHKKEMRYYTYREHTTLYYYLDKCDIKREIFDALFDSNYSGHELMN
ILSNYLRKQFRKKNHKIDNYIVDQLLFDRDTFYILELCNSLRNNILISTILKRYTDSIQDLLLEYVSYHTVYINVIKCMIDEGAT
LYRFKHINKYFQKFGNRDPKVVEYILKNGNLVVDNDNDDNLINIMPLFPTFSMRELDVLSILKLCKPYIDDINKIDKHGCSI
LYHCIKSHSVSLVEWLIDNGADINIITKYGFTCITICVILADKYIPEIAELYIKILEIILSKLPTIECIKKTVDYLDDHRYLFIGGNNK
SLLKICIKYFILVDYKYTCSMYPSYIEFITDCEKEIADMRQIKINGTDMLTVMYMLNKPTKKRYVNNPIFTDWANKQYKFY
NQIIYNANKLIEQSKKIDDMIEEVSIDDNRLSTLPLEIRHLIFSYAFL

>Protein 17:11996..12529, 177 aa

MSSIRFIACLYLISIFGNCHEDPYYQPFNKLNITLDIYTYEDLVPYTVDNDTTSFVKIYFKKFWITVMTKWCAPFIDTVSVYT
SHDNLNIEFYTRDEYDTQSEDKICTIDVKARCNHLTKPEVTVQKEAYRYSLSSDLSCFDSIDLDIDLIETNSTDTTVLKSYEL
MLPKRAKSIHN

>Protein 18:12601..13053, 150 aa

MGIQHEFDIIINGDIALRNLQLHKGDNYGCKLKIISNDYKKLKFRFIIRPDWSEIDEVKGLTVFANNYAVKVNKVDDTFYY
VIYEAVIHLYNKKTEILIYSDDENELFKHYYPYISLNMISKKYKVKEENYSSPYIEHPLIPYRDYESMD

FIG. 14C

>Protein 19:13286..13741, 151 aa

MNAYNKADSFSLESDSIKDVIHDYICWLSMTDEMRPSIGNVFKAMETFKIDAVRYYDGNIYELAKDINAMSFDGFIRSL
QTIASKKDKLTVYGTMGLLSIVVDINKGCDISNIKFAAGIIILMEYIFDDTDMSHLKVALYRRIQRRDDVDR

>Protein 20:13868..14482, 204 aa

MAYMNRSDLDKLKHENIFSGNIIEDAKEFVFGSRKIYTDSVDDLIELYSLAKYLNNENLKDVVIERMDYVCKYIGKDNWS
TIYSFYKENGLRNSFLRQYINNNIEEICNTDQFLKLDVDSVCDILDNDEIVVTREYTILNMVLRWLENKRVNIDDFTKVMF
VIRFKFITYSELTNAIKKIAPEYRQCLQDLYHMKITRPRHFDN

>Protein 21:14545..15495, 316 aa

MDTIKIFNHGEFDTIRNELVNLLKVVKWNTINSNVTVSSTDTIDISDCIREILYKQFKNVRNIEVSSDISFIKYNRFNDTTLTD
DNVGYYLVIYLNRTKSVKTLIYPTPETVITSSEDIMFSKSLNFRFENVKRDYKLVMCSISLTYKPSICRIQYDNNKYLDISDSQ
ECNNLCYCVITMDPHHLIDLETICVLVDKSGKCLLVNEFYIRFRKNHIYNSFADLCMDHIFELPNTKELFTLRNDDGRNIA
WDNDKLESGNNTWIPKTDDEYKFLSKLMNIAKFNNTKFDYYVLVGDTDPCTVFTFKVTKYYINLNYE

>Protein 22:15562..16347, 261 aa

MKVESVTFLTLLGIGCVLSYCPIPSRPINIKFKNSVETNANYNIGDTIEYLCLPGYRKQKMGPIYAKCTGTGWTLFNQCIKR
RCPSPRDIDNGQLDIGGVDFGSSITYSCNSGYQLIGESKSYCELGSTGSMVWNPEAPICESVKCQSPPSISNGRHNGYED
FYTDGSVVTYSCNSGYSLIGNSGVLCSGGEWSDPPTCQIVKCPHPTISNGYLSSGFKRSYSYNDNVDFKCKYGYKLSGSSS
STCSPGNTWKPELPKCVR

>Protein 23:16415..17935, 506 aa

MESVIFSINGEIIQVNKEIITASPYNFFKRIQEHHINDEVIILNGINYHAFESLLDYMRWKKINITINNVEMILVAAVIIDVTP
VVDLCVKTMIHNINSTNCIRMFNFSKQYGIKKLYNASMLEIINNITAVTSDPEFGKLSKDELTTILSHEDVNVNHEDVTA
MILLKWIHKNPNDVDIINILHPKFMTNTMRNAISLLGLTISKSTKPVTRNGIKHNIVVIKNSDYISTITHYSPRTEYWTIVGN
TDRQFYNANVLHNCLYIIGGMINNRHVYSVSRVDLKTKKWKTVTNMSSLKSEVSTCVNDGKLYVIGGLEFSISTGVAEYL
KHGTSKWIRLPNLITPRYSGASVFVNDDIYVMGGVYTTYEKYVVLNDVECFTKNRWIKKSPMPRHHSIVYAVEYDGDIY
AITGITYETRNYLYKYIVKEDKWIELYMYFNHVGKMFVCSCGDYILIIADAKYEYYPKSNTWNLFDMSTRNIEYYDMFTKD
ETHKSLPSFLSNCEKQFLQ

>Protein 24:18002..18676, 224 aa

MVKNNKISNSCRMIMSTNPNNILMRHLKNLTDDEFKCIIHRSSDFLYLSDRDYTSITKETLVSEIVEEYPDDCNKILAIIFLV
LDKDIDVDIKTKLKPKPAVRFAILDKMTEDIKLTDLVRHYFRYIEQDIPLGPLFKKIDSYRTRAINKYSKELGLATEYFNKYGH
LMFYTLPIPYNRFFCRNSIGFLAVLSPTIGHVKAFYKFIEYVSIDDRRKFKKELMSK

>Protein 25:18663..19016, 117 aa

MRTLLIRYILWRNDNDQTYYNDDFKKLMLLDELVDDGDVCTLIKNMRMTLSDGPLLDRLNQPVNNIEDAKRMIAISAK
VARDIGERSEIRWEESFTILFRMIETYFDDLMIDLYGEK

>Protein 26:19136..19663, 175 aa

MTSSAMDNNEPKVLEMVYDATILPEGSSMDPNIMDCINRHINMCIQRTYSSSIIAILDRFLMMNKDELNNTQCHIIKEF
MTYEQMAIDHYGGYVNAILYQIRKRPNQHHTIDLFKRIKRTRYDTFKVDPVEFVKKVIGFVSILNKYKPVYSYVLYENVLY
DEFKCFIDYVETKYF

FIG. 14D

>Protein 27:19705..21123, 472 aa

MIFVIESKLLQIYRNRNRNINFYTTMDNIMSAEYYLSLYAKYNSKNLDVFRNMLQAIEPSGNNYHILHAYCGIKGLDERFV
EELLHRGYSPNETDDDGNYPLHIASKINNNRIVAMLLTHGADPNACDKHNKTPLYYLSGTDDEVIERINLLVQYGAKINN
SVDEEGCGPLLACTDPSERVFKKIMSIGFEARIVDKFGKNHIHRHLMSDNPKASTISWMMKLGISPSKPDHDGNTPLHI
VCSKTVKNVDIIDLLLPSTDVNKQNKFGDSPLTLLIKTLSPAHLINKLLSTSNVITDQTVNICIFYDRDDVLEIINDKGKQYDF
TDFKMAVEVGSIRCVKYLLDNDIICEDAMYYAVLSEYETMVDYLLFNHFSVDSVVNGHTCMSECVRLNNPVILSKLMLH
NPTSETMYLTMKAIEKDRLDKSIIIPFIAYFVLMHPDFCKNRRYFTSYKRFVTDYVHEGVSYEVFDDYF

>Protein 28:21101..21763, 220 aa

MVYKLVLLFCIASLGYSVEYKNTICPPRQDYRYWYFAAELTIGVNYDINSTIIGECHMSESYIDRNANIVLTGYGLEINMTI
MDTDQRFVAAAEGVGKDNKLSVLLFTTQRLDKVHHNISVTITCMEMNCGTTKYDSDLPESIHKSSSCDITINGSCVTCV
NLETDPTKINPHYLHPKDKYLYHNSEYGMRGSYGVTFIDELNQCLLDIKELSYDICYRE

>Protein 29:21898..22752, 284 aa

MDLSRINTWKSKQLKSFLSSKDAFKADVHGHSALYYAIADNNVRLVCTLLNAGALKNLLENEFPLHQAATLEDTKIVKILL
FSGLDDSQFDDKGNTALYYAVDSGNMQTVKLFVKKNWRLMFYGKTGWKTSFYHAVMLNDVSIVSYFLSEIPSTFDLAI
LLSCIHTTIKNGHVDMMILLLDYMTSTNTNNSLLFIPDIKLAIDNKDIEMLQALFKYDINIYSANLENVLLDDAEIAKMIIEK
HVEYKSDSYTKDLDIVKNNKLDEIISKNKELRLMYVNCVKKN

>Protein 30:22974..24083, 369 aa

MIALLILSLTCSVSTYRLQGFTNAGIVAYKNIQDDNIVFSPFGYSFSMFMSLLPASGNTRIELLKTMDLRKRDLGPAFTELIS
GLAKLKTSKYTYTDLTYQSFVDNTVCIKPSYYQQYHRFGLYRLNFRRDAVNKINSIVERRSGMSNVVDSNMLDNNTLWA
IINTIYFKGIWQYPFDITKTRNASFTNKYGTKTVPMMNVVTKLQGNTITIDDEEYDMVRLPYKDANISMYLAIGDNMTH
FTDSITAAKLDYWSFQLGNKVYNLKLPKFSIENKRDIKSIAEMMAPSMFNPDNALFKHMTRDPLYIYKMFQNAKIDVDE
QGTVAEASTIMVATARSSPEKLEFNTPFVFIIRHDITGFILFMGKVESP

>Protein 31:24133..24399, 88 aa

MLAFCYSLPNAGDVIKGRVYENDYALYIYLFDYPHFEAILAESVKMHMDRYVEYRDKLVGKTVKVKVIRVDYTKGYIDVN
YKRMCRHQ

>Protein 32:24451..25725, 424 aa

MNPDNTIAVITETIPIGMQFDKVYLSTFNMWREILSNTTKTLDISSFYWSLSDEVGTNFGTIILNEIVQLPKRGVRVRVAV
NKSNKPLKDVERLQMAGVEVRYIDITNILGGVLHTKFWISDNTHIYLGSANMDWRSLTQVKELGIAIFNNRNLAADLTQ
IFEVYWYLGVNNLPYNWKNFYPSYYNTDHPLSINVSGVPHSVFIASAPQQLCTMERTNDLTALLSCIRNASKFVYVSVM
NFIPIIYSKAGNILFWPYIEDELRRAAIDRQVSVKLLISCWQRSSFIMRNFLRSIAMLKSKNINIEVKLFIVPDADPPIPYSRV
NHAKYMVTDKTAYIGTSNWTGNYFTDTCGASINITPDDGLGLRQQLEDIFMRDWNSKYSYELYDTSPTKRCRLLKNMK
QCTNDIYCDEIQPEKEIPEYSLE

>Protein 33:25901..26266, 121 aa

MGATISILASYDNPNLFTAMILMSPLVNADAVSKLNLLAAKLMGTITPNAPVGKLCPESVSRDMDKVYKYQYDPLINHE
KIKAGFASQVLKATNKVRKIIPKINTPRLSYSREQTMRLAMF

FIG. 14E

>Protein 34:26242..26574, 110 aa

MSANCMFNLDNDYIYWKPITYPKALVFISHGAGKHSGRYDELAENISSLGILVFSHDHIGHGRSNGEKMMIDDFGTYVR
DVVQHVVTIKSTYLGVPVFLLGIPWEQQFLY

>Protein 35:26713..27162, 149 aa

MATKLDYEDAVFYFVDDDKICSRDSIIDLIDEYITWRNHVIVFNKDITSCGRLYKELMKFDDVAIRYYGIDKINEIVEAMSE
GDHYINFTKVHDQESLFATIGICAKITEHWGYKKISESRFQSLGNITDLMTDDNINILILFLEKKLN

>Protein 36:27227..27907, 226 aa

MLSMFMCNNIVDYVDDIDNGIVHDIEDEASNNVDHDYVYPLPENMVYRFDKSTNILDYLSTERDHVMMAVRYYMSK
QRLDDLYRQLPTKTRSYIDIINIYCDKVSNDYNRDMNIMYDMASTKSFTVYDINNEVNTILMDNKGLGVRLATISFITKLG
RRCMNPVKTIKMFTLLSHTICDDCFVDYITDISPPDNTIPNTSTREYLKLIGITAIMFATYKTLKYMIG

>Protein 37:27919..28362, 147 aa

MFNMNINSPVRFVKETNRAKSPTRQSPGAAGYDLYSAYDYTIPPGERQLIKTDISMSMPKICYGRIAPRSGLSLKGIDIGG
GVIDEDYRGNIGVILINNGKCTFNVNTGDRIAQLIYQRIYYPELEEVQSLDSTNRGDQGFGSTGLR

>Protein 38:28386..29828, 480 aa

MPIFVNTVYCKNILALSMTKKFKTIIDAIGGNIIVNSTILKKLSPYFRTHLRQKYTKNKDPVTRVCLDLDIHSLTSIVIYSYTGK
VYIDSHNVVNLLRASILTSVEFIIYTCINFILRDFRKEYCVECYMMGIEYGLSNLLCHTKNFIAKHFLELEDDIIDNFDYLSMK
LILESDELNVPDEDYVVDFVIKWYIKRRNKLGNLLLLIKNVIRSNYLSPRGINNVKWILDCTKIFHCDKQPRKSYKYPFIEYP
MNMDQIIDIFHMCTSTHVGEVVYLIGGWMNNEIHNNAIAVNYISNNWIPIPPMNSPRLYASGIPANNKLYVVGGLPN
PTSVERWFHGDAAWVNMPSLLKPRCNPAVASINNVIYVMGGHSETDTTTEYLLPNHDQWQFGPSTYYPHYKSCALVF
GRRLFLVGRNAEFYCESSNTWTLIDDPIYPRDNPELIIVDNKLLLIGGFYRESYIDTIEVYNHHTYSWNIWDGK

>Protein 39:29839..30798, 319 aa

MEPILAPNPNRFVIFPIQYYDIWNMYKKAEASFWTVEEVDISKDINDWNKLTPDEKYFIKHVLAFFAASDGIVNENLAER
FCTEVQITEARCFYGFQMAIENIHSEMYSLLIDTYVKDSNEKNYLFNAIETMPCVKKKADWAQKWIHDSAGYGERLIAF
AAVEGIFFSGSFASIFWLKKRGLMPGLTFSNELISRDEGLHCDFACLMFKHLLYPPSEETVRSIITDAVSIEQEFLTAALPVK
LIGMNCEMMKTYIEFVADRLISELGFKKIYNVTNPFDFMENISLEGKTNFFEKRVGEYQKMGVMSQKDNHFSLDVDF

>Protein 40:30830..31795, 321 aa

MGTNGVRVFVILYLLAVCGCIEYDVDDNVHICTHTNVSHINHTSWYYNDKVIALATEDKTSGYISSFIKRVNISLTCLNISS
LRYEDSGTYKGVSHLKDGVIVTTTMNISVKANIIDLTGRVRYLTRNYCEVKIRCEITSFALNGSTTPPHMILGTVDKWKYLP
FPTDDYRYVGELKRYISGNPYPTESLALEISSTFNRFTIVKNLNDNEFSCYLFSQNYSFHKMLNVRNICESKWKALNNNDN
ASSMPASHNNLANDLFSMMSQLQNDNDDNNDYSAPMNVDNLIMIVLITMLSIILVIIVVIAAISMYKKSKYRHIDN

>Protein 41:31825..32049, 74 aa

MSKILTFVKNKIIDLINNDQIKYSRVIMIEESDSLLPVDEVHANHGFDCVEMIDENISNENIEQYKTESFFTIN

>Protein 42:32065..32307, 80 aa

MTLVMGSCCGRFCDAKNKNKKEDVEEGREGCYNYKNLNDLDESEARVEFGPLYMINEEKSDINTLDIKRRYRHTIESVY
F

FIG. 14F

>Protein 43:32459..32656, 65 aa

MEGSKRKHDSRRLQQEQEQPRPRTPPSYEEIAKYGHSFNVKRFTNKEMCLKNDYPRIISYNPPPK

>Protein 44:32716..33354, 212 aa

MAETKEFKTLYNLFIDSYLQKLAQHSIPTNVTCAIHIGEVIGQFKNCALRITNKCMSNSRLSFTLMVESFIEVISLLPEKDRR
AIAEEIGIDLDDVPSAVSKLEKNCNAYAEVNNIIDIQKLDIGECSAPPGQHMLLQIVNTGSAEANCGLQTIVKSLNKIYVPP
IIENRLPYYDPWFLVGVAIILVIFTVAICSIRRNLALKYRYGTFLYV

>Protein 45:33341..34660, 439 aa

MGVANDSSPEYQWMSPHRLSDTVILGDCLYFNNIMSQLDLHQNWAPSVRLLNYFKNFNRETLLKIEENDYINSSFFQQ
KDKRFYPINDDFYHISTGGYGIVFKIDNYVVKFVFEATKLYSPMETTAEFTVPKFLYNNLKGDEKKLIVCAWAMGLNYKLT
FLHTLYKRVLHMLLLLIQTMDGQELSLRYSSKVFLKAFNERKDSIKFVKLLSHFYPAVINSNINVINYFNRMFHFFEHEKRT
NYEYERGNIIIFPLALYSADKVDTELAIKLGFKSLVQYIKFIFLQMALLYIKIYELPCCDNFLHADLKPDNILLFDSNEPIIIHLKD
KKFVFNERIKSALNDFDFSQVAGIINKKIKNNFKVKHNWYYDFHFFVHTLLKTYPEIEKDIEFSTALEEFIMCTKTDCDKYRL
KVSILHPISFLEKFIMRDIFSDWINGGN

>Protein 46:34683..35729, 348 aa

MGFCIPLRSKMLKRGSRKSSSILARRPTPKKMNIVTDLENRLKKNSYIENTNQGNILMDSIFVSTMPVETLFGSYITDDSD
DYELKDLLNVTYNIKPVIVPDIKLDAVLDRDGNFRPADCFLVKLKHRDGFTKGALYLGHSAGFTATICLKNEGVSGLYIPGT
SVIRSNICQGDTIVSRSSRGVQFLPQIGGEAIFLIVSLCPTKKLVETGFVIPEISSNDNAKIAARILSEKRKDTIAHINTLIQYRQ
QLELAYYNSCMLTEFLHYCNSYAGTIKESLLKETIQKDINITHTNITTLLNETAKVIKLVKSLVDKEDTDIVNNFITKEIKNRD
KIVNSLSLSNLDFRL

>Protein 47:35772..37679, 635 aa

MLNRVQILMKTANNYETIEILRNYLRLYIILARNEEGHGILIYDDNIDSIMSMMNITRLEVIGLTTHCTKLRSSPPIPMSRLF
MDEIDHESYYSPKTSDYPLIDIIRKRSHEQGDIALALEQYGIENTDSISEINEWLSSKGLACYRFVKFNDYRKQMYRKFSRC
TIVDSMIIGHIGHHYIWIKNLETYTRPEIDVLPFDIKYISRDELWARISSSLDQTHIKTIAVSVYGAITDNGPMPYMISTYPG
NTFVNFNSVKDLILYFLDWIKDIMTSTRTIILVGYMSNLFDIPLLTVYWPNNCGWKIYNNTLISSDGARVIWMDAYKFSC
GLSLQDYCYHWGSKPESRPFDLIKKSDAKRNSKSLVKESMASLKSLYEAFETQSGALEVLMSPCRMFSFSRIEDMFLTSVI
NRVSENTGMGMYYPTNDIPFLFIESSICLDYIIVNNQESNKYRIKSVLDIISSKQYPAGRPNYVKNGTKGKLYIALCKVTVPT
NDHIPVVYHDDDNTTTFITVLTSVDIETAIRAGYSIVELGALQWDDNIPELKDCLLDSIKMIYDLNAVTTNNLLEQLIENIN
FNNSSIISLFYTFAISYCRAFIYSIMETIDPVYISQFSYKELYVSSSYKDINESMSQMVKL

>Protein 48:37713..38831, 372 aa

MWPFASVPAGAKCRLVETLPENMDFRSDHLTTFECFNEIITLAKKYIYIASFCCNPLSTTRGALIFDKLKEASEKGIKIIVLLD
ERGKRNLGELQSHCPDINFITVNIDKKNNVGLLLGCFWVSDDERCYVGNASFTGGSIHTIKTLGVYSDYPPLATDLRRRF
DTFKAFNSAKNSWLNLCSAACCLPVSTAYHIKNPIGGVFFTDSPEHLLGYSRDLDTDVVIDKLRSAKTSIDIEHLAIVPTTR
VDGNSYYWPDIYNSIIEAAINRGVKIRLLVGNWDKNDVYSMATARSLDALCVQNDLSVKVFTIQNNTKLLIVDDEYVHIT
SANFDGTHYQNHGFVSFNSIDKQLVSEAKKIFERDWVSSHSKSLKI

>Protein 49:38849..39070, 73 aa

MKHRLYSEGLSISNDLNSIIGQQSTMDTDIEINEDDIMELLNILTELGCDVDFDENFSDIADDILESLIEQDV

FIG. 14G

>Protein 50:39120..39269, 49 aa

MVIGLVIFVSVAAAIVGVLSNVLDMFMYVEENNEEDARIKEEQELLLLY

>Protein 51:39342..39818, 158 aa

MRSIAGLHKLKMEIFNVEELINMKPFKNMNKITINQKDNCILANRCFVKIDTPRYIPSTSISSSNIIRIRNHDFTLSELLYSPF
HFQQPQFQYLLPGFVLTCIDKVSKQQKECKYCISNRGDDDSLSINLFIPTINKSIYIIIGLRMKNFWKPKFEIE

>Protein 52:39825..40520, 231 aa

MKVVIVTSVASLLDASIQFQKTACRHHCNYLSMQVVKEIEEFGTINEKNLEFDTWKDVIQNDEIDALVFYRVKQISISTGV
LYKSMMRNRTKPISMYFVRDCLAFDGDPPSFRMTSCNINAYNRNKIKDLIILMNMKTCNKKIIGEFIIDNFGSVDALLSII
NSNVTWITSVINNSNGRGINIRVSNNKMLTITSFRRFVNKLKMYKTTKCASQLDNLCTEMNKMDIIDKK

>Protein 53:40583..40888, 101 aa

MNSHFASAHTPFYINTKEGRYLVLKAVKVCDVRTVECEGSKASCVLKVDKPSSPACERRPSSPSRCERMNNPGKQVPF
MRTDMLQNMFAANRDNVASRLLS

>Protein 54:40885..42324, 479 aa

MNRNPDQNTFPNITLKIIETYLGRVPSVNEYHMLKLQARNIQKITVFNKDIFVSLVKKNKKRFFSDVNTSASEIKDRILSYF
SKQTQTYNIGKLFTIIELQSVLVTTYTDILGVLTIKAPNVISSKISYNVTSMEELARDMLNSMNVAVIDKAKVMGRHNVSS
LVKNVNKLMEEYLRRHNKSCICYGSYSLYLINPNILYGDIDILQTNSRTFLIDLAFLIKFITGNNIILSKIPYLRNYMVIKDEND
NHIIDSFNIRQDTMNVVPKIFIDNIYIVDPTFQLLNMIKMFSQIDRLEDLSKDPEKFNARMATMLEYVRYTHGIVFDGKR
NNMPMKCIIDENNRIVTVTTKDYFSFKKCLVYLDENVLSSDILDLNADTSCDFESVTNSVYLIHDNIMYTYFSNTILLSDKG
KVHEISARGLCAHILLYQMLTSGEYKQCLSDLLNSMMNRDKIPIYSHTERDKKPGRHGFINIEKDIIVF

>Protein 55:42321..44534, 737 aa

MISVTDIRRAFLDNECHTITKAFGYLHEDKAIALIKIGFHPTYLPKVLYNNVVEFVPEKLYLFKPRTVAPLDLISTITKLKNVD
KFASHINYHKNSILITGDKSLIVKCMPYMIISDDDIRFIREQFVGTNSIEYILSFINKESIYRMSYQFSENEIVTIINRDHFMYE
PIYEHQVLDSDFLKTMLDRYGIVPINSGIIDELCPEAIIEILMAVVRPRDAIRFLDIVNKNQLTEDSVKNYIINDIRRGKIDYYI
PYVEDFLEDRTEDLGIYANIFFEDAIDITKLDITKTELEHISKYMNYYTTYIDHIVNIILQNNYIDILASIIDYVQDVLTEELCIRI
VCESTNPVPVTSLPIHSTLVMVMCIQMKYVDIVEFLDEIDIDTLIEKGADPITEYTFTTRWYNKHNDLITLYIKKYGFCPM
MMKRLMFEYPLTKEASDHLLKTMDENRGAIMFFPRTICTLPYLLCCNYKLIQKPIPFKEENRNIVYKKNNRVLCFDSLENS
AFKSLIKIDSIPGLKTYNMKDITYEKSNNIICVRFIPQESIHNEERRIKLQLFDIARLASYGLYYIPSRYLSSWTPVVNMIEGRE
YTNPQKIECLVILDLFSEEFIEYQNLGNAVSNKYELEYTISNYQAAINCLMSTLLIYLVLGSIRSISKTEDFVLSILNIFYKGLKIN
ELLSEPVSGVCIELDKIKDRASSGDSSFIFLKKNELSKTLSLCEKVCVETILDNNQSFKSSK

>Protein 56:44661..45233, 190 aa

MSKIYIDERSDAEIVCAAIKNIGIEGATAAQLTRQLNMEKREVNKALYDLQRSAMVYSSDDIPPRWFMTTEADKPDADV
MADAIIDDVSREKSMREDHKSFDDVIPAKKIIDWKDANPVTIINEYCQITKRDWSFRIESVGPSNSPTFYACVDIDGRVF
DKADGKSKRDAKNNAAKLAVDKLLGYVIIRF

>Protein 57:45288..46067, 259 aa

MENVYISSYSSNEQTSMAVAATDIRELLSQYVDDANLEDLIEWAMEKSSKYYIKNIGNTKSNIEETKFESKNNIGIEYSKDS
RNKLSYRNKPSIATNLEYKTLCDMIKGTSGTEKEFLRYLLFGIKCIKKGVEYNIDKIKDVSYNDYFNVLDEKYNTPCPNCKSR

FIG. 14H

NTTPMMIQTRAADEPPLVRHACRDCKQHFKPPKFRAFRNLNVTTQSIHENKEITEILPDNNPSPPESPEPASPIDDGLIRS
TFDRNDEPPEDDE

>Protein 58:46148..47143, 331 aa

MLIIVLWLYGYNFIMSESQCPMINDDSFTLKRKYQIDSAESTIKMDKKRIKFQNRAKMVKEINQTIRAAQTHYETLKLGYI
KFKRMIRTTTLEDIAPSIPNNQKTYKLFSDISAIGKASQNPSKMVYALLLYMFPNLFGDDHRFIRYRMHPMSKIKHKIFSPF
KLNLIRILVEERFYNNECRSNKWKIIGTQVDKMLIAESDKYTIDARYNLKPMYRIKGESEEDTLFIKQMVEQCVTSQELVE
KVLKILFRDLFKSGEYKAYRYDDDVENGFIGLDTLKLNIVHDIVEPCMPVRRPVAKILCKEMVNKYFENPLHIIGKNLQECI
DFVSE

>Protein 59:47280..48983, 567 aa

MDFIRRKYLIYTVENNIDFLKDDTLSKVNNFTLNHVLALKYLVSNFPQHVITKDVLANTNFFVFIHMVRCCKVYEAVLRHA
FDAPTLYVKALTKNYLSFSNAIQSYKETVHKLTQDEKFLEVAEYMDELGELIGVNYDLVLNPLFHGGEPIKDMEIIFLKLFK
KTDFKVVKKLSVIRLLIWAYLSKKDTGIEFADNDRQDIYTLFQQTGRIVHSNLTETFRDYIFPGDKTSYWVWLNESIANDA
DIVLNRHAITMYDKILSYIYSEIKQGRVNKNMLKLVYIFEPEKDIRELLLEIIYDIPGDILSIIDAKNDDWKKYFISFYKANFING
NTFISDRTFNEDLFRVVVQIDPEYFDNERIMSLFSTSAADIKRFDELDINNSYISNIIYEVNDITLDTMDDMKKCQIFNEDT
SYYVKEYNTYLFLHESDPMVIENGILKKLSSIKSKSRRLNLFSKNILKYYLDGQLARLGLVLDDYKGDLLVKMINHLKSVEDV
SAFVRFSTDKNPSILPSLIKTILASYNISIIVLFQRFLRDNLYHVEEFLDKSIHLTKTDKKYILQLIRHGRS

>Protein 60:49065..49565, 166 aa

MGTAATIQTPTKLMNKENAEMILEKIVDHIVMYISDESSDSENNPEYIDFRNRYEDYRSLIIKSDHEFVKLCKNHAEKSSP
ETQQMIIKHIYEQYLIPVSEVLLKPIMSMGDIITYNGCKDNEWMLEQLSTLNFNNLRTWNSCSIGNVTRLFYTFFSYLMK
DKLNI

>Protein 61:49690..50511, 273 aa

MAATVPRFDDVYKNAQRRILDQETFFSRGLSRPLMKNTYLFDNYAYGWIPETAIWSSRYANLDASDYYPISLGLLKKFEF
LMSLYKGPIPVYEEKVNTEFIANGSFSGRYVSYLRKFSALPTNEFISFLLLTSIPIYNILFWFKNTQFDITKHTLFRYVYTDNAK
HLALARYMHQTGDYKPLFSRLKENYIFTGPVPIGIKDINHPNLSRARSPSDYETLANISTILYFTKYDPVLMFLLFYVPGYSIT
TKITPAVEYLMDKLNLTKSDVQLL

>Protein 62:50518..53538, 1006 aa

MDVRCINWFESHGENRFLYLKSRCRNGETVFIRFPHYFYYVVTDEIYQSLSPPPFNARPLGKMRTIDIDETISYNLDIKDRK
CSVADMWLIEEPKKRSIQNATMDEFLNISWFYISNGISPDGCYSLDEQYLTKINNGCYHCDDPRNCFAKKIPRFDIPRSYL
FLDIECHFDKKFPSVFINPISHTSYCYIDLSGKRLLFTLINEEMLTEQEIQEAVDRGCLRIQSLMEMDYERELVLCSEIVLLRIA
KQLLELTFDYVVTFNGHNFDLRYITNRLELLTGEKIIFRSPDKKEAVHLCIYERNQSSHKGVGGMANTTFHVNNNNGTIFF
DLYSFIQKSEKLDSYKLDSISKNAFSCMGKVLNRGVREMTFIGDDTTDAKGKAAAFAKVLTTGNYVTVDEDIICKVIRKDI
WENGFKVVLLCPTLPNDTYKLSFGKDDVDLAQMYKDYNLNIALDMARYCIHDACLCQYLWEYYGVETKTDAGASTYVL
PQSMVFEYRASTVIKGPLLKLLLETKTILVRSETKQKFPYEGGKVFAPKQKMFSNNVLIFDYNSLYPNVCIFGNLSPETLVG
VVVSTNRLEEEINNQLLLQKYPPPRYITVHCEPRLPNLISEIAIFDRSIEGTIPRLLRTFLAERARYKKMLKQATSSTEKAIYDS
MQYTYKIVANSVYGLMGFRNSALYSYASAKSCTSIGRRMILYLESVLNGAELSNGMLRFANPLSNPFYMDDRDINPIVK
TSLPIDYRFRFRSVYGDTDSVFTEIDSQDVDKSIEIAKELERLINNRVLFNNFKIEFEAVYKNLIMQSKKKYTTMKYSASSNS
KSVPERINKGTSETRRDVSKFHKNMIKTYKTRLSEMLSEGRMNSNQVCIDILRSLETDLRSEFDSRSSPLELFMLSRMHHS
NYKSADNPNMYLVTEYNKNNPETIELGERYYFAYICPANVPWTKKLVNIKTYETIIDRSFKLGSDQRIFYEVYFKRLTSEIV
NLLDNKVLCISFFERMFGSKPTFYEA

FIG. 14I

>Protein 63:53570..53857, 95 aa

MNPKHWGRAVWTIIFIVLSQAGLDGNIEACKRKLYTIVSTLPCPACRRHATIAIEDNNVMSSDDLNYIYYFFIRLFNNLAS
DPKYAIDVTKVNPL

>Protein 64:53852..54241, 129 aa

MELVNIFLETDAGRVKFAIKNTDDVCASELINKFVELLSEYIHIDQSEFYLVVKDKDIFYFKCDRGSISIVNNEFYVFDEPLLF
VKDFTNVTGVEFIVTETMPCRIIPKNNHAVISVVTNHKFYNGLSL

>Protein 65:54228..56228, 666 aa

MFMYPEFARKALSKLISKKLNIEKVSSKHQLVLLDYGLHGLLPKSLYLEAINSDILNVRFFPPEIINVTDIVKALQNSCRVDEY
LKSVSLYHKNSLMVSGPNVVKLMIEYNLLTHSDLEWLINENVVKATYLLKINAYMINFKIDLTVDEIIDLVKDIPVGATLHL
YNILNNIDLDIVLRISDEYNIPPVHDILSKLTDEEMCIKLVTKYPMDNVINFINQDVRYSPTFIKTIKDFVNEHLPTMYDGLN
DYLHSVIIDEDLIEEYKIKSVAMFNLEYKTDVNTLTLDEQIFVEVNISYYDFRYRQFADEFRDYIMIKERRQITMQSGDRIRR
FRRPMSLRSTIIKKDTDSLEDILAHIDNARKNSKVSIEDVERIISSFRLNPCVVRRTMLSDIDIKTKIMVLKIVKDWKSCALTL
SAIKGIMVTDTINTVLSKILHHHRNVFKYLTSVENKEIAVCNCSRCLSLFYRELKSVRCDLRTDDGLLDRLYDLTRYALHGKI
NQNLIGQRCWGPLTEMLFNENKKKKLNNLMEYIKISDMLVYGHSIEKTLIPITDSLSFKLSVDTMSVLNDQYAKVVIFFN
TIIEYIIATIYYRLTVLNNYTNVKHFVSKVLHTVMEACGVLFSYIKVNDKIEHELEEMVDKGTVPSYLYHLSINVISIILDDING
TR

>Protein 66:56276..56602, 108 aa

MAEEFVQQRLANNKVTIFVKYTCPFCRNALDILNKFSFKRGAYEIVDIKEFKPENELRDYFEQITGGRTVPRIFFGKTSIGG
YSDLLEIDNMDALGDILSSIGVLRTC

>Protein 67:56748..57686, 312 aa

MAEFEDQLVFNSISARALKAYFTAKINEMVDELVTRKCPQKKKSQAKKPEVRIPVDLVKSSFVKKFGLCNYGGILISLINSL
VENNFFTKDGKLDDTGKKELVLTDVEKRILNTIDKSSPLYIDISDVKVLAARLKRSATQFNFNGHTYHLENDKIEDLINQLV
KDESIQLDEKSSIKDSMYVIPDELIDVLKTRLFRSPQVKDNIISRTRLYDYFTRVTKRDESSIYVILKDPRIASILSLETVKMGA
FMYTKHSMLTNAISSRVDRYSKKFQESFYEDIAEFVKENERVNVSRVVECLTVPNITISSNAE

>Protein 68:57693..57914, 73 aa

MDKLYAAIFGVFMGSPEDDLTDFIEIVKSVLSDEKTVTSTNNTGCWGWYWLIIIFFIVLILLLLIYLYLKVVW

>Protein 69:57915..58724, 269 aa

MSKVIKKRVETSPRPTASSDSLQTCAGVIEYAKSISKSNAKCIEYVTLNASQYANCSSISIKLTDSLSSQMTSTFIMLEGETKL
YKNKSKQDRSDGYFLKIKVTAASPMLYQLLEAVYGNIKHKERIPNSLHSLSVETITEKTFKDESIFINKLNGAMVEYVSTGE
SSILRSIEGELESLSKRERQLAKAIITPVVFYRSGTETKITFALKKLIIDREVVANVIGLSGDSERVSMTENVEEDLARNLGLVD
IDDEYDEDSDKEKPIFNV

>Protein 70:58807..61122, 771 aa

MFVIKRNGYKENVMFDKITSRIRKLCYGLNTDHIDPIKIAMKVIQGIYNGVTTVELDTLAAEIAATCTTQHPDYAILAARIA
VSNLHKETKKLFSEVMEDLFNYVNPKNGKHSPIISSITMDIVNKYKDKLNSVIIYERDFSYNYFGFKTLEKSYLLKINNKIVER
PQHMLMRVAVGIHQWDIDSAIETYNLLSEKWFTHASPTLFNAGTSRHQMSSCFLLNMIDDSIEGIYDTLKRCALISKMA
GGIGLSISNIRASGSYISGTNGISNGIIPMLRVYNNTARYIDQGGNKRPGVMAIYLEPWHSDIMAFLDLKKNTGNEEHRT

FIG. 14J

RDLFIALWIPDLFMKRVKDDGEWSLMCPDECPGLDNVWGDEFERLYTLYERERRYKSIIKARVVWKAIIESQIETGTPFIL
YKDACNKKSNQQNLGTIKCSNLCTEIIQYADANEVAVCNLASVALNMFVIDGRFDFLKLKDVVKVIVRNLNKIIDINYYPI
PEAEISNKRHRPIGIGVQGLADAFILLNYPFDSLEAQDLNKKIFETIYYGALEASCELAEKEGPYDTYVGSYASNGILQYDL
WNVVPSDLWNWEPLKDKIRTYGLRNSLLVAPMPTASTAQILGNNESVEPYTSNIYTRRVLSGEFQVVNPHLLRVLTERK
LWNDEIKNRIMADGGSIQNTNLPEDIKRVYKTIWEIPQKTIIKMAADRGAFIDQSQSMNIHIADPSYSKLTSMHFYGWS
LGLKTGMYYLRTKPASAPIQFTLDKDKIKPPVVCDSEICTSCSG

>Protein 71:61149..61388, 79 aa

MVDAITVLTAIGITVLMLLMVISGAALIVKELNPNDIFTMQSLKFNRAVTIFKYIGLFIYIPGTIILYATYVKSLLMKS

>Protein 72:61407..62555, 382 aa

MNNFVKQVASKSLKPTKKLSPSDEVISLNECIISFNLDNFYYCNDVLFTKPINTPEDVLKSLLIMESFAYEKMIIKGLIKILIFR
AYINDIYFTPFGWLTGVDDDPETHVVIKIIFNSSLISIKSQVIEYLKPYNVNNLSVLTTEKELSINTFNVPDSIPMSIISFFPFDT
DFILVILFFGVYNDSYCGISYISPKERLPYIIEILKPLVSEINMLSDEIGRTSSIRIFNSTSVKKFPTNTLTSICEIVYSFDESSFPTP
KTFTPLNASPYIPKKIVSLLDLPSNVEIKAISRGGVDFITHINNKRLNTILVIAKDNFLKNSTFSGTFIKENIIWKGIYTYRIIKSS
FPVPTIKSVTNKKKICKKHCFVNSQYTTRTLSHIL

>Protein 73:62548..63819, 423 aa

MERYTDLVISKIPELGFTNLLCHIYSLAGLCSNIDVSKFLTNCNGYVVEKYDKSTTAGKVSCIPIGMMLELVELGHLSRPNS
SDELDQKKELTDELKTRYHSIYDVFELPTSIPLAYFFKPRLREKVSKAIDFSQMDLKIDDLSRKGIHTGENPKVVKMKIEPER
GAWMSNRSIKNLVSQFAYGSEVDYIGQFDMRFLNSLAIHEKFDAFMNKHILSYILKDKIKSSTSRFVMFGFCYLSHWKC
VIYDKKQCLVSFYDSGGNIPTEFHHYNNFYFYSFSDGFNTNHRHSVLDNTNCDIDVLFRFFECTFGAKIGCINVEVNQLLE
SECGMFISLFMILCTRTPPKSFKSLKKVYTFFKFLADKKMTLFKSILFNLHDLSLDITETDNAGLKEYKRMEKWTKKSINVIC
DKLTTKLNRIVNDDE

>Protein 74:63825..65855, 676 aa

MEKNLPDIFFFPNCVNVFSYKYSQDEFSNMSKTERDSFSLAVFPVIKHRWHNAHVVKHKGIYKVSTEARGKKVSPPSLG
KPAHINLTAKQYIYSEHTISFECYSFLKCITNTEINSFDEYILRGLLEAGNSLQIFSNSVGKRTDTIGVLGNKYPFSKIPLASLTP
KAQREIFSAWISHRPVVLTGGTGVGKTSQVPKLLLWFNYLFGGFSTLDKITNFHERPVILSLPRIALVRLHSNTILKSLGFKV
LDGSPISLRYGSIPEELINKQPKKYGIVFSTHKLSLTKLFSYGTLIIDEVHEHDQIGDIIIAVARKHHTKIDSMFLMTATLEDDR
ERLKVFLPNPAFIHIPGDTLFKISEVFIHNKINPSSRMAYIEEEKRNLVTAIQMYTPPDGSSGIVFVASVAQCHEYKSYLEKR
LPYDMYIIHGKVLDIDEILEKVYSSPNVSIIISTPYLESSVTIRNVTHIYDMGKVFVPAPFGGSQEFISKSMRDQRKGRVGRV
NPGTYVYFYDLSYMKSIQRIDSEFLHNYILYANKFNLTLPEDLFIIPTNLDILWRTKEYIDSFDISTETWNKLLSNYYMKMIE
YAKLYVLSPILAEELDNFERTGELTSIVREAILSLNLRIKILNFKHKDDDTYIHFCKILFGVYNGTNATIYYHRPLTGYMNMIS
DTIFVPVDNN

>Protein 75:65859..67634, 591 aa

MIVLPNKVRIFINDRMKKDIYLGISNFGFENDIDEILGIAHLLEHLLISFDSTNFLANASTSRSYMSFWCKSINSATESDAIRT
LVSWFFSNGKLKDNFSLSSIRFHIKELENEYYFRNEVFHCMDILTFLSGGDLYNGGRIDMIDNLNIVRDMLVNRMQRISG
SNIVIFVKRLGPGTLDFFKQTFGSLPACPEIIPSSIPVSTNGKIVMTPSPFYTVMVKINPTLDNILGILYLYETYHLIDYETIGN
QLYLTVSFIDETEYESFLRGEAILQISQCCQSINMNYSDDYMMNIYLNFPWLSHDLYDYITRINDDSKSILISLTNEIYASIINR
DIIVIYPNFSKAMCNTRDTQQHPIVVLDATNDGLIKKPYRSIPLMKRLTSNEIFIRYGDASLMDMITLSLSKQDISLKRNAE
GIRVKHSFSADDIQAIMESDSFLKYSRSKPAAMYQYIFLSFFASGNSIDDILANRDSTLEFSKRTKSKILFGRNTRYDVTAKS

FIG. 14K

SFVCGIVRGKSLDKTSLVEMMWDLKKKGLIYSMEFTNLLSKNTFYLFTFTIYTDEVYDYLNTNKLFSAKCLVVSTKGDVEN
FSSLKKDVVIRV

>Protein 76:67631..67966, 111 aa

MASLLYLILFLLFVCISYYFTYYPTNKLQAAVMETDRENAIIRQRNDEIPTRTLDTAIFTDASTVASAQIHLYYNSNIGKIIMS
LNGKKHTFNLYDDNDIRTLLPILLLSK

>Protein 77:67960..68622, 220 aa

MPFRDLILFNLSKFLLTEDEESLEIVSSLCRGFEISYDDLITYFPDRKYHKYISKVFEHVDLSEELSMEFHDTTLRDLVYLRLYK
YSKCIRPCYKLGDNLKGIVVIKDRNIYIREANDDLIEYLLKEYTPQIYTYSNERVPITGSKLILCGFSQVTFMAYTTSHITTNKK
VDVLVSKKCIDELVDPINYQILQNLFDKGSGTINKILRKIFYSVTGGQTP

>Protein 78:68592..68966, 124 aa

MKNVLIIFGKPYCSICENVSDAVEELKSEYDILHVDILSFFLKDGDSSMLGDVKRGTLIGNFAAHLSNYIVSIFKYNPQTKQ
MAFVDINKSLDFTKTDKSLVNLEILKSEIEKANYGVWPPVTE

>Protein 79:68969..70273, 434 aa

MGIKNLKSLLLENKSLTILDDNLYKVYNGIFVDTMSIYIAVANCVRNLEELTTVFIKYVNGWVKKGGHVTLFIDRGSIKIKQ
DVRDKRRKYSKLTKDRKMLELEKCTSEIQNVTGFMEEEIKAEMQLKIDKLTFQIYLSDSDNIKISLNEILTHFNNNENVTLF
YCDERDAEFVMCLEAKTHFSTTGEWPLIISTDQDTMLFASTDNHPKMIKNLTQLFKFVPSAEDNYLAKLTALVNGCDFF
PGLYGASITPTNLNKIQLFSDFTIDNIVTSLAIKNYYRKTNSTVDVRNIVTFINDYANLDDVYSYVPPCQCTVQEFIFSALDE
KWNNFKSSYLETVPLPCQLMYALEPRKEIDVSEVKTLSSYIDFENTKSDIDVIKSISSIFGYSNENCNTIVFGIYKDNLLLSINS
SFYFNDSLLITNTKSDNIIINIGY

>Protein 80:70281..70472, 63 aa

MVFQLVCSTCGKDISHERYKLIIRKKSLKDVLVSVKNECCRLKLSTQIEPQRNLTVQPLLDIN

>Protein 81:70474..70971, 165 aa

MDPVNFIKTYAPRGSIIFINYTMSLTSHLNPSIEKHVGIYYGTLLSEHLVVESTYRKGVRIVPLDSFFEGYLSAKVYMLENIQ
VMKIAADTSLTLLGIPYGFGHDRMYCFKLVAECYKNAGIDTSSKRILGKDIFLSQNFTDDNRWIKIYDSNNLTFWQIDYLK
G

>Protein 82:70936..72051, 371 aa

MAAEQRRSTIFDIVSKCIVQSVLRDISINSEYIESKAKQLCYCPASKKESVINGIYNCCESNIEIMDKEQLLKILDNLRCHSAH
VCNATDFWRLYNSLKRFTHTTAFFNTCKPTILATLNTLITLILSNKLLYAAEMVEYLENQLDSSNKSMSQELAELLEMKYAL
INLVQYRILPMIIGEPIIVAGFSGKEPISDYSAEVERLMELPVKTDIVNTTYDFLARKGIDTSNNIAEYIAGLKIEEIEKVEKYLP
EVISTIANSNIIKNKKSIFPANINDKQIMECSRMLDTSEKYSKGYKTDGAVTSPLTGNNTITTFIPISASDMQKFTILEYLYIM
RVMANNVKKKNEGKNNGGVVMHINSPFKVINLPKC

>Protein 83:72082..72864, 260 aa

MSIRIKIDKLRQIVAYFSEFSEEVSINVDSTDELMYIFAALGGSVNIWAIIPLSASVFYRGAENIVFNLPVSKVKSCLCSFHND
AIIDIEPDLENNLVKLSSYHVVSVDCNKELMPIRTDTTICLSIDQKKSYVFNFHKYEEKCCGRTVIHLEWLLGFIKCISQHQH

FIG. 14L

LAIMFKDDNIIMKTPGNTDAFSREYSMTECSQELQKFSFKIAISSLNKLRGFKKRVNVFETRIVMDNDDNILGMLFSDRV
QSFKINIFMTFLD

>Protein 84:72884..73906, 340 aa

MGGGVSVELPKRDPPPGVPTDEMLLNVDKMHDVIAPAKLLEYVHIGPLAKDKEDKVKKRYPEFRLVNTGPGGLSALLR
QSYNGTAPNCCRTFNRTHYWKKDGKISDKYEEGAVLESCWPDVHDTGKCDVDLFDWCQGDTFDRNICHQWIGSAFN
RSNRTVEGQQSLINLYNKMQTLCSKDASVPICESFLHHLRAHNTEDSKEMIDYILRQQSADFKQKYMRCSYPTRDKLEES
LKYAEPRECWDPECSNANVNFLLTRNYNNLGLCNIVRCNTSVNNLQMDKTSSLRLSCGLSNSDRFSTVPVNRAKVVQH
NIKHSFDLKLHLISLLSLLVIWILIVAI

>Protein 85:73907..74659, 250 aa

MGAAASIQTTVNTLSERISSKLEQEANASAQTKCDIEIGNFYIRQNHGCNLTVKNMCSADADAQLDAVLSAATETYSGL
TPEQKAYVPAMFTAALNIQTSVNTVVRDFENYVKQTCNSSAVVDNKLKIQNVIIDECYGAPGSPTNLEFINTGSSKGNC
AIKALMQLTTKATTQIAPKQVAGTGVQFYMIVIGVIILAALFMYYAKRMLFTSTNDKIKLILANKENVHWTTYMDTFFRT
SPMVIATTDMQN

>Protein 86:74691..74954, 87 aa

MEVITDRLDDIVKQNIADEKFVDFVIHGLEHQCPAILRPLIRLFIDILLFVIVIYIFTVRLVSRNYQMLLALVALVITLTIFYYFIL

>Protein 87:74944..75996, 350 aa

MNTRTDVTNDNIDKNPTKRGDKNIPGRNERFNDQNRFNNDIPKPKPRLQPNQPPKQDNKCREENGDFINIRLCAYEK
EYCNDGYLSPAYYMLKQVDDEEMSCWSELSSLVRSRKAVGFPLLKAAKRISHGSMLYFEQFKNSKVVRLTPQVKCLNDT
VIFQTVVILYSMYKRGIYSNEFCFDLVSIPRTNIVFSVNQLMFNICTDILVVLSICGNRLYRTNLPQSCYLNFIHGHETIARR
GYEHSNYFFEWLIKNHISLLTKQTMDILKVKKKYAIGAPVNRLLEPGTLVYVPKEDYYFIGISLTDVSISDNVRVLFSTDGIV
LEIEDFNIKHLFMAGEMFVRSQSSTIIV

>Protein 88:76021..76776, 251 aa

MSLLLENLIEEDTIFFAGSISEYDDLQMVIAGAKSKFPRSMLSIFNIVPRTMSKYELELIHNENITGAMFTTMYNIRNNLGL
GDDKLTIEAIENYFLDPNNEVMPLIINNTDMTAVIPKKSGRRKNKNMVIFRQGSSPILCIFETRKKINIYKENMESASTEYT
PIGDNKALISKYAGINVLNVYSPSTSMRLNAIYGFTNKNKLEKLSTNKELESYSSSPLQEPIRLNDFLGLLECVKKNIPLTDIP
TKD

>Protein 89:76786..77172, 128 aa

MENVPNVYFNPVFIEPTFKHSLLSVYKHRLIVLFEVFVVFILIYVFFRSELNMFFMPKRKIPDPIDRLRRANLACEDDKLMIY
GLPWMTTQTSALSINSKPIVYKDCAKLLRSINGSQPVSLNDVLRR

>Protein 90:77129..77590, 153 aa

MDHNQYLLTMFFADDDSFFKYLASQDDESSLSDILQITQYLDFLLLLLIQSKNKLEAVGHCYESLSEEYRQLTKFTDFQDFK
KLFNKVPIVTDGRVKLNKGYLFDFVISLMRFKKESSLATTAIDPIRYIDPRRDIAFSNVMDILKSNKVNNN

>Protein 91:78860..79861, 333 aa

MDVVSLDKPFMYFEEIDNELDYEPESANEVAKKLPYQGQLKLLLGELFFLSKLQRHGILDGATVVYIGSAPGTHIRYLRDH
FYNLGVIIKWMLIDGRHHDPILNGLRDVTLVTRFVDEEYLRSIKKQLHPSKIILISDVRSKRGGNEPSTADLLSNYALQNV

FIG. 14M

MISILNPVASSLKWRCPFPDQWIKDFYIPHGNKMLQPFAPSYSAEMRLLSIYTGENMRLTRVTKLDAVNYEKKMYYLNK
IVRNKVVVNFDYPNQEYDYFHMYFMLRTVYCNKTFPTTKAKVLFLQQSIFRFLNIPTTSTEKVSHEPIQRKISSKNSMSKN
RNSKRSVRGNK

>Protein 92:79776..80333, 185 aa

MNQYNVKYLAKILCLKTEIARDPYAVINRNVLLRYTTDIEYNDLVTLITVRHKIDSMKTVFQVFNESSINYTPVDDDYGEPII
ITSYLQKGHNKFPVNFLYIDVVISDLFPSFVRLDTTETNIVNSVLQTGDGKKTLRLPKMLETEIVVKILYRPNIPLKIVRFFRN
NMVTGVEIADRSVISVAD

>Protein 93:80415..80816, 133 aa

MTDEQIYAFCDANKDDIRCKCIYPDKSIVRIGIDTRLPYYCWYEPCKRSDALLPASLKKNITKCNVSDCTISLGNVSITDSKL
DVNNVCDSKRVATENIAVRYLNQEIRYPIIDIKWLPIGLLALAILILAFF

>Protein 94:80923..84783, 1286 aa

MAVISKVTYSLYDQKEINATDIIISHVKNDDDIGTVKDGRLGAMDGALCKTCGKTELECFGHWGKVSIYKTHIVKPEFISEI
IRLLNHICIHCGLLRSREPYSDDINLKELSGHALRRLKDKILSKKKSCWNSECMQPYQKITFSKKKVCFVNKLDDINVPNSLI
YQKLISIHEKFWPLLEIHQYPANLFYTDYFPIPPLIIRPAISFWIDSIPKETNELTYLLGMIVKNCNLNADEQVIQKAVIEYDDI
KIISNNTTSINLSYITSGKNNMIRSYIVARRKDQTARSVIGPSTSITVNEVGMPAYIRNTLTEKIFVNAFTVDKVKQLLASNQ
VKFYFNKRLNQLTRIRQGKFIKNKIHLLPGDWVEVAVQEYTSIIFGRQPSLHRYNVIASSIRATEGDTIKISPGIANSQNAD
FDGDEEWMILEQNPKAVIEQSILMYPTTLLKHDIHGAPVYGSIQDEIVAAYSLFRIQDLCLDEVLNILGKYGREFDPKGKC
KFSGKDIYTYLIGEKINYPGLLKDGEIIANDVDSNFVVAMRHLSLAGLLSDHKSNVEGINFIIKSSYVFKRYLSIYGFGVTFKD
LRPNSTFTNKLEAINVEKIELIKEAYAKYLNDVRDGKIVPLSKALEADYVESMLSNLTNLNIREIEEHMRQTLIDDPDNNLL
KMAKAGYKVNPTELMYILGTYGQQRIDGEPAETRVLGRVLPYYLPDSKDPEGRGYILNSLTKGLTGSQYYFSMLVARSQ
STDIVCETSRTGTLARKIIKKMEDMVVDGYGQVVIGNTLIKYAANYTKILGSVCKPVDLIYPDESMTWYLEISALWNKIKQ
GFVYSQKQKLAKKTLAPFNFLVFVKPTTEDNAIKVKDLYDMIHNVIDDVREKYFFTVSNIDFMEYIFLTHLNPSRIRITKET
AITIFEKFYEKLNYTLGGGTPIGIISAQVLSEKFTQQALSSFHTTEKSGAVKQKLGFNEFNNLTNLSKNKTEIITLVSDDISKL
QSVKINFEFVCLGELNPDITLRKETDRYVVDIIVNRLYIKRAEITELVVEYMIERFISFSVIVKEWGMETFIEDEDNIRFTVYL
NFVEPEELNLSKFMMVLPGAANKGKISKFKIPISDYTGYDDFNQTKKLNKMTVELMNLKELGSFDLENVNVYPGVWNT
YDIFGIEAAREYLCEAMLNTYGEGFDYLYQPCDLLASLLCASYEPESVNKFKFGAASTLKRATFGDNKALLNAALHKKSEPI
NDNSSCHFFSKVPNIGTGYYKYFIDLGLLMRMERKLSDKISSQKIKEMEETEDF

>Protein 95:84780..85295, 171 aa

MDKKSLYKYLLLRSTGDMHRAKSPTIMTRVTNNVYLGNYKNAMDAPSSEVKFKYVLNLTMDKYTLPNSNINIIHIPLVD
DTTTDISKYFDDVTAFLSKCDQRNEPVLVHCAAGVNRSGAMILAYLMSKNKESLPMLYFLYVYHSMRDLRGAFVENPSF
KRQIIEKYVIDKN

>Protein 96:85309..85878, 189 aa

MDKTTLSVNACNLEYVREKAIVGVQAAKTSTLIFFVIILAISALLLWFQTSDNPVFNELTRYMRIKNTVNDWKSLTDSKTK
LESDRGRLLAAGKDDIFEFKCVDFGAYFIAMRLDKKTYLPQAIRRGTGDAWMVKKAAKVDPSAQQFCQYLIKHKSNNVI
TCGNEMLNELGYSGYFMSPHWCSDFSNME

>Protein 97:85881..86855, 324 aa

MAAAKTPVIVVPVIDRLPSETFPNVHEHINDQKFDDVKDNEVMPEKRNVVVVKDDPDHYKDYAFIQWTGGNIRNDDK
YTHFFSGFCNTMCTEETKRNIARHLALWDSNFFTELENKKVEYVVIVENDNVIEDITFLRPVLKAMHDKKIDILQMREIIT

FIG. 14N

GNKVKTELVMDKNHAIFTYTGGYDVSLSAYIIRVTTALNIVDEIIKSGGLSSGFYFEIARIENEMKINRQILDNAAKYVEHD
PRLVAEHRFENMKPNFWSRIGTAATKRYPGVMYAFTTPLISFFGLFDINVIGLIVILFIMFMLIFNVKSKLLWFLTGTFVTA
FI

>Protein 98:86856..89243, 795 aa

MDSKETILIEIIPKIKAYLLDANISPKSYDDFISRNKNIFVINLYNVSTITEEDIRLLYTTIEQNIDADDQTLVAIFSYIGYKFEQA
VKEEISTSLSFNDKNTTDEMTYNLYDLFFNTLDMYLRQKKISILVNDDVRGDVIVSYKNSDLVSSFNAELEPEIKKIPFNMK
NLLPYLEKNLDQLRFSKKYLDFAYLCRHIGIPISKKKYNVRYVFLYKIDGLSIPIIIKDFLDVKYVYLENTGKIYKNSFSEDHNN
SLSDWGKVIIPLLKDRHLYSYIFLSSYHLHSYYTDLIARDEPVFVKRKKLDIIEIDEPEAWKRDVRVEFAPCEHQIRLKEAMK
VDANYFTKINNFANEFIYYEDGVAYCRVCGINIPIFNLDAADVIKNTVIVSTFNKTIFLSEPYSYFVHSQRFIFNIIMSFDNIM
KSQTWVMKYNINRLILNFLIDINSRRQEYEKKFSSEIKRGLFFLRLSANLFESQVSSTELFYVSKMLNLNYIVALVIILNSSAD
FIVSYMTSKNKTVEESTLKYAISVVIYDFLVKTRICEKGSLDTIVLFTDVYTSIMPEELDLHFQRITLELRKLVSIQRSALEPNY
DVESRGEELPLSALKFFDTSTIIVKTMAPVHTYIEQKIVAPTPSVEPTDASLKNFKELTCDEDIKILIRVHDTNATKLVIFPSHL
KIEIERKKLIIPLKSLYITNTLKYYYSNSYLYVFRFGDPMPFEEELIDHEHVQYKINCYNILRYHLLPDSDVFVYFSNSLNREAL
EYAFYIFLSKYVNVKQWIDENITRIKELYMINFNN

>Protein 99:89429..90040, 203 aa

MAWSITNKADTSSFTKMAEIRAHLKNSAENKDKNEDIFPEDVIIPSTKPKTKRATTPRKPAATKRSTKKEEVEEEVVIEEY
HQTTEKNSPSPGVSDIVESVAAVELDDSDGDDEPMVQVEAGKVNHSARSDLSDLKVATDNIVKDLKKIITRISAVSTVLE
DVQAAGISRQFTSMTKAITTLSDLVTEGKSKVVRKKVKTCKK

>Protein 100:90041..90985, 314 aa

MRALFYKDGKLFTDNNFLNPVSDDNPAYEVLQHVKIPTHLTDVVVYEQTWEEALTRLIFVGSDSKGRRQYFYGKMHVQ
NRNAKRDRIFVRVYNVMKRINCFINKNIKKSSTDSNYQLAVFMLMETMFFIRFGKMKYLKENETVGLLTLKNKHIEISPD
EIVIKFVGKDKVSHEFVVHKSNRLYKPLLKLTDDSSPEEFLFNKLSERKVYECIKQFGIRIKDLRTYGVNYTFLYNFWTNVKSI
SPLPSPKKLIALTIKQTAEVVGHTPSISKRAYMATTILEMVKDKNFLDVVSKTTFDEFLSIVVDHVKSSTDG

>Protein 101:91022..91462, 146 aa

MEMDKRMKSLAMTAFFGELSTLDIMALIMSIFKRHPNNTIFSVDKDGQFMIDFEYDNYKASQYLDLTLTPIFGDECKTH
ASSIAEQLACADIIKEDISEYIKTTPRLKRFIKKYRNRSDTRISRDTEKLKIALAKGIDYEYIKDAC

>Protein 102:91506..94040, 844 aa

MDANIVSSSTIATYIDALAKNASELEQRSTAYEINNELELVFIKPPLITLTNVVNISTIQESFIRFTVTNKEGVKIRTKIPLSKVH
GLDVKNVQLVDAIDNIVWEKKSLVTENRLHKECLLRLSTEERHIFLDYKKYGSSIRLELVNLIQAKTKNFTIDFKLKYFLGSG
AQSKSSLLHAINHPKSRPNTSLEIEFTPRDNEKVPYDELIKELTTLSRHIFMASPENVILSPPINAPIKTFMLPKQDIVGLDLE
NLYAVTKTDGIPITIRVTSNGLYCYFTHLGYIIRYPVKRIIDSEVVVFGEAVKDKNWTVYLIKLIEPVNAINDRLEESKYVESKL
VDICDRIVFKSKKYEGPFTTTSEVVDMLSTYLPKQPEGVILFYSKGPKSNIDFKIKKENTIDQTANVVFRYMSSEPIIFGESSI
FVEYKKFSNDKGFPKEYGSGKIVLYNGVNYLNNIYCLEYINTHNEVGIKSVVVPIKFIAEFLVNGEILKPRIDKTMKYINSED
YYGNQHNIIVEHLRDQSIKIGDIFNEDKLSDVGHQYANNDKFRLNPEVSYFTNKRTRGPLGILSNYVKTLLISMYCSKTFLD
DSNKRKVLAIDFGNGADLEKYFYGEIALLVATDPDADAIARGNERYNKLNSGIKTKYYKFDYIQETIRSDTFVSSVREVFYF
GKFNIIDWQFAIHYSFHPRHYATVMNNLSELTASGGKVLITTMDGDKLSKLTDKKTFIIHKNLPSSENYMSVEKIADDRIV
VYNPSTMSTPMTEYIIKKNDIVRVFNEYGFVLVDNVDFATIIERSKKFINGASTMEDRPSTKNFFELNRGAIKCEGLDVED
LLSYYVVYVFSKR

FIG. 14O

>Protein 103:93999..94439, 146 aa

MSINIDIKKITDLLNSSILFPDDVQELLREKYIVLERKSNGTPTVAHIYKTMARFDNKSIYRIAKFLFMNRPDVIKLLFLEDVE
PLLPDKSINISINNTEYPQLEGPIGTKIALLELFNAFRTGISEPIPYYYLPLRKDINNIVTK

>Protein 104:94432..95145, 237 aa

MDIFIVKDNKYPKVDNDDNEVFILLGNHNDFIRSKLTKLKEHVFFSEYIVTPDKYGSLCVELNGSSFQHGGRYIEVEEFIDA
GRQVRWCSTSNHISEDIPEDIHTDKFVIYDIYTFDAFKNKRLVFVQVPPSLGDDSYLTNPLLSPYYRNSVARQMVNDMIF
NQDSFLKYLLEHLIRSHYRVSKHITIVRYKDTEELNLTRICYNRDKFKAFVFAWFNGVSENEKVLDTYKKVSNLI

>Protein 105:95145..95801, 218 aa

MNSVTVSHAPYTITYHDDWEPVMSQLVEFYNEVASWLLRDETSPIPDKFFIQLKQPLRNKRVCVCGIDPYPKDGTGVPF
ESPNFTKKSIKEIASSISRLTGVIDYKGYNLNIIDGVIPWNYYLSCKLGETKSHAIYWDKISKLLLQHITKHVSVLYCLGKTDFS
NIRAKLESPVTTIVGYHPAARDRQFEKDRSFEIINVLLELDNKAPINWAQGFIY

>Protein 106:95833..98190, 785 aa

MDAAIRGNDVIFVLKTIGVPSACRQNEDPRFVEAFKCDELERYIENNPECTLFESLRDEEAYSIVRIFMDVDLDACLDEIDY
LTAIQDFIIEVSNCVARFAFTECGAIHENVIKSMRSNFSLTKSTNRDKTSFHIIFLDTYTTMDTLIAMKRTLLELSRSSENPLT
RSIDTAVYRRKTTLRVVGTRKNPNCDTIHVMQPPHDNIEDYLFTYVDMNNNSYYFSLQQRLEDLVPDKLWEPGFISFED
AIKRVSKIFINSIINFNDLDENNFTTVPLVIDYVTPCALCKKRSHKHPHQLSLENGAIRIYKTGNPHSCKVKIVPLDGNKLFNI
AQRILDTNSVLLTERGDHIVWINNSWKFNSEEPLITKLILSIRHQLPKEYSSELLCPRKRKTVEANIRDMLVDSVETDTYPD
KLPFKNGVLDLVDGMFYSGDDAKKYTCTVSTGFKFDDTKFVEDSPEMEELMNIINDIQPLTDENKKNRELYEKTLSSCLC
GATKGCLTFFFGETATGKSTTKRLLKSAIGDLFVETGQTILTDVLDKGPNPFIANMHLKRSVFCSELPDFACSGSKKIRSDN
IKKLTEPCVIGRPCFSNKINNRNHATIIIDTNYKPVFDRIDNALMRRIAVVRFRTHFSQPSGREAAENNDAYDKVKLLDEG
LDGKIQNNRYRFAFLYLLVKWYRKYHVPIMKLYPTPEEIPDFAFYLKIGTLLVSSSVKHIPLMTDLSKKGYILYDNVVTLPLT
TFQQKISKYFNSRLFGHDIESFINRHKKFANVSDEYLQYIFIEDISSP

>Protein 107:98231..100144, 637 aa

MNTGIIDLFDNHVDSIPTILPHQLATLDYLVRTIIDENRSVLLFHIMGSGKTIIALLFALVASRFKKVYILVPNINILKIFNYNM
GVAMNLFNDEFIAENIFIHSTTSFYSLNYNDNVINYNGLSRYNNSIFIVDEAHNIFGNNTGELMTVIKNKNKIPFLLLSGSPI
TNTPNTLGHIIDLMSEETIDFGEIISRGKKVIQTLLNERGVNVLKDLLKGRISYYEMPDKDLPTIRYHGRKFLDTRVVYCHM
SKLQERDYMITRRQLCYHEMFDKNMYNVSMAVLGQLNLMNNLDTLFQEQDKELYPNLKINNGVLYGEELVTLNISSKF
KYFINRIQTLNGKHFIYFSNSTYGGLVIKYIMLSNGYSEYNGSQGTNPHMINGKPKTFAIVTSKMKSSLEDLLDVYNSPEN
DDGSQLMFLFSSNIMSESYTLKEVRHIWFMTIPDTFSQYNQILGRSIRKFSYADISEPVNVYLLAAVYSDFNDEVTSLNDY
TQDELINVLPFDIKKLLYLKFKTKETNRIYSILQEMSETYSLPPHPSIVKVLLGELVRQFFYNNSRIKYNDSKLLKMVTSVIKN
KEDARNYIDDIVNGHFFVSNKVFDKSLLYKYENDIITVPFRLSYEPFVWGVNFRKEYNVVSSP

>Protein 108:100171..100656, 161 aa

MSSFVTNGYLPVTLEPHELTLDIKTNIRNAVYKTYLHREISGKMAKKIEIREDVELPLGEIVNNSVVINVPCVITYAYYHVG
DIVRGTLNIEDESNVTIQCGDLICKLSRDSGTVSFSDSKYCFFRNGNAYDNGSEVTAVLMEAQQGIESSFVFLANIVDS

>Protein 109:100619..101533, 304 aa

MPQQLSPINIETKKAISNARLKPLDIHYNESKPTTIQNTGKLVRINFKGGYISGGFLPNEYVLSSLHIYWGKEDDYGSNHLI
DVYKYSGEINLVHWNKKKYSSYEEAKKHDDGLIIISIFLQVLDHKNVYFQKIVNQLDSIRSANTSAPFDSVFYLDNLLPSKL

FIG. 14P

DYFTYLGTTINHSADAVWIIFPTPINIHSDQLSKFRTLLSSSNHDGKPHYITENYRNPYKLNDDTQVYYSGEIIRAATTSPAR
ENYFMRWLSDLRETCFSYYQKYIEENKTFAIIAIVFVFILTAILFFMSRRYSREKQN

>Protein 110:101575..102216, 213 aa

MGITMDEEVIFETPRELISIKRIKDIPRSKDTHVFAACITSDGYPLIGARRTSFAFQAILSQQNSDSIFRVSTKLLRFMYYNEL
REIFRRLRKGSINNIDPHFEELILLGGKLDKKESIKDCLRRELKEESDERITVKEFGNVILKLTTRDKLFNKVYISYCMACFINQ
SLEDLSHTSIYNVEIRKIKSLNDCINDDKYEYLSYIYNMLVNSK

>Protein 111:102213..102959, 248 aa

MNFYRSSIISQIIKYNRRLAKSIICEDDSQIITLTAFVNQCLWCHKRVSVSAILLTTDNKILVCNRRDSFLYSEIIRTRNMSRKK
RLFLNYSNYLSKQERSILSSFFSLDPATTDNDRIDAIYPGGIPKRGENVPECLSREIKEEVNIDNSFVFIDTRFFIHGIIEDTIIN
KFFEVIFFVGRISLTSDQIIDTFKSNHEIKDLIFLDPNSGNGLQYEIAKYALDTAKLKCYGHRGCYYESLKKLTEDD

>Protein 112:102960..104855, 631 aa

MSKSHAAYIDYALRRTTNMPVEMMGSDVVRLKDYQHFVARVFLGLDSMHSLLLFHETGVGKTMTTVYILKHLKDIYTN
WAIILLVKKALIEDPWMNTILRYAPEITKDCIFINYDDQNFRNKFFTNIKTINSKSRICVIIDECHNFISKSLIKEDGKIRPTRS
VYNFLSKTIALKNHKMICLSATPIVNSVQEFTMLVNLLRPGSLQHQSLFENKRLVDEKELVSKLGGLCSYIVNNEFSIFDDV
EGSASFAKKTVLMRYVNMSKKQEEIYQKAKLAEIKTGISSFRILRRMATTFTFDSFPERQNRDPGEYAQEIATLYNDFKNS
LRDREFSKSALDTFKKGELLKGDASAADISLFTELKEKSVKFIDVCLGILASHGKCLVFEPFVNQSGIEILLLYFKVFGISNIEFS
SRTKDTRIKAVAEFNQESNTNGECIKTCVFSSSGGEGISFFSINDIFILDMTWNEASLRQIVGRAIRLNSHVLTPPERRYVN
VHFIMARLSNGMPTVDEDLFEIIQSKSKEFVQLFRVFKHTSLEWIHANEKDFSPIDNESGWKTLVSRAIDLSSKKNITNKLI
EGTNIWYSNSNRLMSINRGFKGVDGRVYDVDGNYLHDMPDNPVIKIHDGKLIYIF

>Protein 113:104890..105753, 287 aa

MDEIVKNIREGTHVLLPFYETLPELNLSLGKSPLPSLEYGANYFLQISRVNDLNRMPTDMLKLFTHDIMLPESDLDKVYEIL
KINSVKYYGRSTKADAVVADLSARNKLFKRRERDAIKSNNHLTENNLYISDYKMLTFDVFRPLFDFVNEKYCIIKLPTLFGRG
VIDTMRIYCSLFKNVRLLKCVSDSWLKDSAIMVASDVCKKNLDLFMSHVKSVTKSSSWKDVNSVQFSILNNPVDTEFINK
FLEFSNRVYEALYYVHSLLYSSMTSDSKSIENKHQRRLVKLLL

>Protein 114:105784..107439, 551 aa

MNNTIINSLIGGDDSIKRSNVFAVDSQIPTLYMPQYISLSGVMTNDGPDNQAIASFEIRDQYITALNHLVLSLELPEVKGM
GRFGYVPVGYKCINHVSISSCNGVIWEIEGEELYNNCINNTIALKHSGYSSELNDISIGLTPNDTIKEPSTVYVYIKTPFDVE
DTFSSLKLSDSKITVTVTFNPVSDIVIRDSSFDFETFNKEFVYVPELSFIGYMVKNVQIKPSFIEKPRRVIGQINQPTATVTEV
HAATSLSVYTKPYYGNTDNKFISYPGYSQDEKDYIDAYVSRLLDDLVIVSDGPPTGYPESAEIVEVPEDGIVSIQDADVYVK
IDNVPDNMSVYLHTNLLMFGTRKNSFIYNISKKFSAITGTYSDATKRTIFAHISHSINIIDTSIPVSLWTSQRNVYNGDNRS
AESKAKDLFINDPFIKGIDFKNKTDIISRLEVRFGNDVLYSENGPISRIYNELLTKSNNGTRTLTFNFTPKIFFRPTTITANVSR
GKDKLSVRVVYSTMDVNHPIYYVQKQLVVVCNDLYKVSYDQGVSITKIMGDNN

>Protein 115:107463..107915, 150 aa

MAKRVSLPDVVISAPKAVFKPAKEEALACILPKYYKSMADVSIKTNSVIDKCWFCNQDLVFKPISIETFKGGEVGYFCSKIC
RDSLASMVKSHVALREEPKISLLPLVFYEDKEKVINTINLLRDKDGVYGSCYFKENSQIIDISLRSLL

FIG. 14Q

>Protein 116:107936..108610, 224 aa

MNLRLCSGCRHNGIVSEQGYEYCIFCESVFQKCTKVQKKSNFHVSNKLIHLRNVLRRLLSHQCSGEIISELLDIMEKNQIST
DDVDANFVSSFLKANERINKKDYKLVFEIINQVKDEKLNLSTEKINEVVEIFKHLVFFCQENTPSKTINYSFFLDKIFDITSVT
KNLKPQTVKNYTKNNSNQLVWENFLAHMRSKKRVTMVEDYGHEYVFVDERFSTCSLEV

>Protein 117:108607..108837, 76 aa

MSWYEKYNIVLNPPKRCSFACADNLTTILAEDGNNIRAILYSQPKKLKILQDFLATSRNKMFLYKILDDEIRRVLT

>Protein 118:108852..110786, 644 aa

MEAVVNSDVFLTSNAGLKSSYTNQTLSLVDEDHIHTSDKSLSCSVCNSLSKIVDDDFISAGARNQRTKPKRAGNNQSQQ
PIKKDCMVSIDEVASTHDWSTRLRNDGNAIAKYLTTNKYDTSNFTIQDMLNIMNKLNIVRTNRNELFQLLTHVKSTLNN
ASVSVKCTHPLVLIHSRASPRIGDQLKELDKIYSPSNHHILLSTTRFQSMHFTDMSSSQDLSFIYRKPETNYYIHPILMALFG
IKLPALENAYVHGDTYSLIQQLYEFRKVKSYNYMLLVNRLTEDNPIVITGVSDLISTEIQRANMHTMIRKAIMNIRMGIFY
CNDDDAVDPHLMKIIHTGCSQVMTDEEQILASILSIVGFRPTLVSVARPINGISYDMKLQAAPYIVVNPMKMITTSDSPIS
INSKDIYSMAFDGNSGRVVFAPPNIGYGRCSGVTHIDPLGTNVMGSAVHSPVIVNGAMMFYVERRQNKNMFGGECY
TGFRSLIDDTPIDVSPEIMLNGIMYRLKSAVCYKLGDQFFDCGSSDIFLKGHYTILFTENGPWMYDPLSVFNPGARNARL
MRALKNQYKKLSMDSDDGFYEWLNGDGSVFAASKQQMLMNHVANFDDDLLTMEEAMSMISRHCCILIYAQDYDQ
YISARHITELF

>Protein 119:110839..111690, 283 aa

MDFFNKFSQGLAESSTPKSSIYYSEKKDPDTKKDEAIEIGLKSQESYYQRQLREQLARDNMMAASRQPIQPLQPTIHITP
QPVPVPTPTSAPILLPSSTAPTPKPRQQTNTSSDMSNLFDWLSADTDAPASSLLPALTPSNAVQDIISKFNKDQKTTTPPS
TQPSQTLPTTTCTQQSDGSISCTTPTVTPPQPPIVATVCTPTPTGGTVCTTAQQNPNPGAASQQNLDDMALKDLMSSV
EKDMHQLQAETNDLVTNVYDAREYTRRAIDQILQLVKGFERFQK

>Protein 120:111728..112222, 164 aa

MADTDDIIDYESDDLTEYEDDEEEEEDGESLETSDIDPKSSYKIVESASTHIEDAHSNLKHIGNHISALKRRYTRRISLFEIAG
IIAESYNLLQRGRLPLVSEFSDETMKQNMLHVIIQEIEEGSCPIVIEKNGELLSVNDFDKDGLKFHLDYIIKIWKLQKRY

>Protein 121:112219..113337, 372 aa

MDKLRVLYDEFVTISKDNLERETGLSASDVDMDFDLNIFMTLVPVLEKKVCAITPTIEDDKIVTMMKYCSYQSFSFWFLK
SGAVVKSVYNKLDDVKKEKFVATFRDMLLNVQTLISLNSMYTRLRQDTEDIVSDSKKIMEIVSHLRASTTENAAYQVLQ
QNNSFIISTLNKILSDENYLLKIIAVFDSKLISEKETLNEYKQLYTISSESLVYGIRCVSNLDISSVQLSNNKYVLFVKKMLPKIIL
FQNNDINAQQFANVISKIYTLIYRQLTSNVDVGCLLTDTIESAKTKISVEKIKQTGINNVQSLIKFISDNKKEYKTIISEEYLSK
EDRIITILQDIVNEHDIKYDNKLLNMRDLIVTFRERYSYKF

>Protein 122:113361..115493, 710 aa

MRYIVSPQLVLQVGKGQEVERALYLTPYDYIDEKSPIYYFLRSHLNIQQPEIVKRHILLTLRMTQLKGYLGNLLDIKDDIIIYS
HKNNLEYSYVDNTIFNPFVYTQKKTLLKNDSFLYNVYPGACDFLVIWVARACDTSIPEFGSYEDVDNNIIKFETMLMEVF
PQLDLDITIESKFNNIFRTNLKLTGLKKIIQRVQDLDINYKSLLSRYDEHFINMTGNHFILNDEQLNLSIWDLDGTLALSSDG
DTVMINNVKLFTDLVSDIDTQMERIKGDITYKVHLATPINSRIKLDIETSFIFIETATNNILLSSDKKISIILAKNHISIKVKNHIP
NIEKYFTFLVIAINAMFNSVQKSADFTKVETVYWSRICQNTKNKNRKPIIINYLDPGMKKISNNFYRSDEKEVFINDNGIM
FTCMDPLGKYNKVGFLNIFHDMRKYCIPCCFLHDQSHRSTFSSCVHQIDVEKKIVSPYILNFGKVVTESKMSFLPIIFDAFL

FIG. 14R

NDGMTANMEQDNKRLKETSGYHIVRCCAGDDIVRLRTTSDIIQFVNEDKNILIVNDMVYFPMNASDIGKKIHILIQEIVH
EVMIVKKKESSDKIDFFPPNYKLLKDLFPKQTIQTPIQSDAGMVLTTDGFYIDGKLFNEDLSSKYVTFTKNVIASDAVAKYF
SPLFKYVISEAKDRFIKTWMINIMIHMNVDPNNIIPTLEKYYPNSGRAQIN

>Protein 123:115547..116413, 288 aa

MFEPVPDLNLEASVELGEVNIDQTTPMIKENSGFISRSRRLFAHRSKDDERKLALRFFLQRLYFLDHREIHYLFRCVDAVK
DVTITKKNNIIVAPYIALLTIASKGCKLTETMIEAFFPELYNEHSKKFKFNSQVSIIQEKLGYQFGNYHVYDFEPYYSTVALAI
RDEHSSGIFNIRQESYLVSSLSEITYRFYLINLKSDLVQWSASTGAVINQMVNTVLITVYEKLQLVIENDSQFTCSLAVESKL
PIKLLKDRNELFTKFINELKKTSSFKISKRDKDTLLKYFT

>Protein 124:116406..116705, 99 aa

MSCYTAILKSVGGLALFQVANGAIDLCRHFFMYFCEQKLRPNSFWFVVVRAIASMIMYLVLGIALLYISEQDNKKNTNN
DGSNNDKRNESSINSNSSPK

>Protein 125:116706..119381, 891 aa

MMPIKSIVTLDQLEDSEYLFRIVSTVLPHLCLDYKVCDKLKTTFVHPFDILLNNSLGSVTKQDELQAAISKLGINYLIDTTSRE
LKLFNVTLNAGNIDIINTPINISSETNPIINTHSFYDLPPFTQHLLNIRLTDTEYRARFIGGYIKPDGSDSMDVLAEKKYPDLN
FDNTYLFNILYKDVINAPIKEFKAKIVNGVLSRQDFDNLIGVRQYITIQDRPRFDDAYNIADAARHYGVNLNTLPLPNVDL
TTMPTYKHLIMFEQYFIYTYDRVDIYYNGNKMLFDDEIINFTISMRYQSLIPRLVDFFPDIPVNNNIVLHTRDPQNAAVNV
TVALPNVQFVDINRNNKFFINFFNLLAKEQRSTAIKVTKSMFWDGMDYEEYKSKNLQDMMFINSTCYVFGLYNHNNT
TYCSILSDIISAEKTPIRVCLLPRVVGGKTVTNLISETLKSISSMTIREFPRKDKSIMHIGLSETGFMRFFQLLRLMADKPHET
AIKEVVMAYVGIKLGDKGSPYYIRKESYQDFIYLLFASMGFKVTTRRSIMGSNNISIISIRPKVTKQYIVTTLMKTSCSKNEA
EKLITSAFDLLNFMVSVSDFRDYQSYRQYRNYCPRYFYAGSPEGEETIICDSEPISILDRIDTRGIFSAYTINEMMDTDIFSP
ENKAFKNNLSRFIESGDITGEDIFCAMPYNILDRIITNAGTCTVSIGDMLDNITTQSDCNMTNEITDMINASLKNTISKDN
NMLVSQALDSVANRSKQTIGDLRQSSCKMALLFKNLVTSIYTIERIFNAKVGDDVKASMLEKYKVFTDISMSLYKDLIAM
ENLKAMLYIIRRSGCRIDDAQITTDDLVKSYSLIRPKILSMINYYNEMSRGYFEHMKKNLNMTDGDSVSFDDE

>Protein 126:119396..120352, 318 aa

MTTVPVTDIQNDLITEFSEDNYPSNKNYEITLRQMSILTHVNNVVDREHNAAVVSSPEEISSQLNEDLFPDDDSPATIIER
VQPHTTIIDDTPPPTFRRELLISEQRQQREKRFNITVSKNAEAIMESRSMITSMPTQTPSLGVVYDKDKRIQMLEDEVVN
LRNQRSNTKSSDNLDNFTKILFGKTPYKSTEVNKRIAIVNYANLNGSPLSVEDLDVCSEDEIDRIYKTIKQYHESRKRKIIVT
NVIIIVINIIEQALLKLGFEEIKGLSTDITSEIIDVEIGDDCDAVASKLGIGNSPVLNIVLFILKIFVKRIKII

>Protein 127:120354..120932, 192 aa

MADKKNLAVRSSYDDYIETVNKITPQLKNLLAQIGGDAAVKGGNNNLNSQTDVTAGACDTKSKSSKCITCKPKSKSSSSS
TSASKGSKNTSGAPKRRTTVTTTSYNAMDGQIVQAVTNAGKIVYGTVRDGQLEVRGMVGEINHDLLGIDSVNAGKKK
PSKKMPTNKKINMSSGMRRQEQINPDDCCLDMGMY

>Protein 128:120956..121168, 70 aa

MIGILLLIGICVAVTVAILYSMYNKIKNLQNLNPSPNLNSPPPEPKNTKFVNNLEKDHISSLYNLVKSSA

>Protein 129:121276..121548, 90 aa

FIG. 14S

MDMMLMIGNYFSGVLIAGIILLILSCIFAFIDFSKSTSPTRTWKVLSIMAFILGIIITVGMLIYSMWGKHCAPHRVSGVIHT
NHSDISMN

>Protein 130:121565..121726, 53 aa

MISNYEPLLLLVITCCVLLFNFTISSKTKIDIIFAVQTIVFIWFIFHFVHSAI

>Protein 131:121716..122000, 94 aa

MFVDDNSLIIYSTWPSTLSDSSGRVIVMPDNRSFTFKEGFKLDESIKSILLVNPSSIDLLKIRVYKHRIKWMGDIFVLFEQEN
IPPPFRLVNDK

>Protein 132:121984..123117, 377 aa

MGAAVTLNRIKIAPGIADIRDKYMELGFNYPEYNRAVKFAEESYTYYYETSPGEIKPKFCLIDGMSIDHCSSFIVPEFAKQY
VLIHGEPCSSFKFRPGSLIYYQNEVTPEYIKDLKHATDYIASGQRCHFIKKDYLLGDSDSVAKCCSKTNTKHCPKIFNNNYK
TEHCDDFMTGFCRNDPGNPNCLEWLRAKRKPAMSTYSDICSKHMDARYCSEFIRIIRPDYFTFGDTALYVFCNDHKGN
RNCWCANYPKSNSGDKYLGPRVCWLHECTDESRDRKWLYYNQDVQRTRCKYVGCTINVNSLALKNSQAELTSNCTRT
TSAVGDVHPGEPVVKDKIKLPTWLGAAITLVVISVIFYFISIYSRPKIKTNDINVRRR

>Protein 133:123120..123731, 203 aa

MSYLRYYNMLDDFSAGAGVLDKDLFTEEQQQSFMPKDGGMMQNDYGGMNDYLGIFKNNDVRTLLGLILFVLALYSP
PLISILMIFISSFLLPLTSLVITYCLVTQMYRGGNGNTVGMSIVCIVAAVIIMAINVFTNSQIFNIISYIILFILFFAYVMNIERQ
DYRRSINVTIPEQYTCNKPYTAGNKVDVDIPTFNSLNTDDY

>Protein 134:123746..125227, 493 aa

MSLLKMEYNLYAELKKMTCGQPLSLFNEDGDFVEVEPGSSFKFLIPKGFYASPSVKTSLVFETLTTTDNKITSINPTNAPKL
YPLQRKVVSEVVSNMRKMIESKRPLYITLHLACGFGKTITTCYLMATHGRKTVICVPNKMLIHQWKTQVEAVGLEHKISI
DGVSSLLKELKTQSPDVLIVVSRHLTNDAFCKYINKHYDLFILDESHTYNLMNNTAVTRFLAYYPPMMCYFLTATPRPSN
RIYCNSIINIAKLSDLKKTIYAVDSFFEPYSTDNIRHMIKRLDGPSNKYHIYTEKLLSVDEPRNQLILDTLVEEFKSGTINRILVI
TKLREHMVFFYKRLLDLFGPEVVFIGDAQNRRTPDMVKSIKELNRFIFVSTLFYSGTGLDIPSLDSLFICSAVINNMQIEQLL
GRVCRETELLDRTVYVFPNTSIKEIKYMIGNFMQRIISLSVDKLGFKQKSYRKHQESDPTSVCTTSSREERVLNRIFNSQNR

>Protein 135:125208..125441, 77 aa

MDSTNVRSGMKSRKKKPKTTVIDDDDDCMTCSACQSKLVKISDITKVSLDYINTMRGNTLACAACGSSLKLLNDFAS

>Protein 136:125442..125795, 117 aa

MITLFLILCYFILIFNIIVPAISEKMRRERAAYVNYKRLNKNFICVDDRLFSYNFTTSGIKAKMAVDNKNVPIPCSKINEVNN
NKDVDTLYCDKDRDDIPGFARSCYRAYSDLFFTT

>Protein 137:125794..127074, 426 aa

MTSSADLTNLKELLSLYKSLRFSDSAAIEKYNSLVEWGTSTYWKIGVQKVANVETSISDYYDEVKNKPFNIDPGYYIFLPVY
FGSVFIYSKGKNMVELGSGNSFQIPDDMRSACNKVLDSDNGIDFLRFVLLNNRWIMEDAISKYQSPVNIFKLASEYGLNI
PKYLEIEIEEDTLFDDELYSIIERSFDDKFPKISISYIKLGELRRQVVDFFKFSFMYIESIKVDRIGDNIFIPSVITKSGKKILVKDV
DHLIRSKVREHTFVKVKKKNTFSILYDYDGNGTETRGEVIKRIIDTIGRDYYVNGKYFSKVGSAGLKQLTNKLDINECATVD

FIG. 14T

ELVDEINKSGTVKRKIKNQSAFDLSRECLGYPEADFITLVNNMRFKIENCKVVNFNIENTNCLNNPSIETIYGNFNQFVSIF
NIVTDVKKRLFE

>Protein 138:127004..127567, 187 aa

METLTSSSQSLISSPMSKKDYSSEIICAFDIGAKNPARTVLEVKDNSVRVLDISKLDWSSDWERRIAKDLSQYEYTTVLLER
QPRRSPYVKFIYFIKGFLYHTSAAKVICVSPVMSGNSYRDRKKRSVEAFLDWMDTFGLRDSVPDRRKLDDVADSFNLAM
RYVLDKWNTNYTPYNRCKSRNYIKKM

>Protein 139:127587..128735, 382 aa

MDNLFTFLHEIEDRYARTIFNFHLISCDEIGDIYGLMKERISSEDMFDNIVYNKDIHPAIKKLVYCDIQLTKHIINQNTYPVF
NDSSQVKCCHYFDINSDNSNISSRTVEIFEREKSSLVSYIKTTNKKRKVNYGEIKKTVHGGTNANYFSGKKSDEYLSTTVRS
NINQPWIKTISKRMRVDIINHSIVTRGKSSILQTIEIIFTNRTCVKIFKDSTMHIILSKDKDEKGCIHMIDKLFYVYYNLFLLFE
DIIQNEYFKEVANVVNHVLTATALDEKLFLIKKMAEHDVYGVSNFKIGMFNLTFIKSLDHTVFPSLLDEDSKIKFFKGKKLN
IVALRSLEDCINYVTKSENMIEMMKERSTILNSIDIETESVDRLKELLLK

>Protein 140:128732..132226, 1164 aa

MKKNTDSEMDQRLGYKFLVPDPKAGVFYRPLHFQYVSYSNFILHRLHEILTVKRPLLSFKNNTERIMIEISNVKVTPPDYS
PIIASIKGKSYDALATFTVNIFKEVMTKEGISITKISSYEGKDSHLIKIPLLIGYGNKNPLDTAKYLVPNVIGGVFINKQSVEKV
GINLVEKITTWPKFRVVKPNSFTFSFSSVSPPNVLPTRYRHYKISLDISQLEALNISSTKTFITVNIVLLSQYLSRVSLEFIRRSL
SYDMPPEVVYLVNAIIDSAKRITESITDFNIDTYINDLVEAEHIKQKSQLTINEFKYEMLHNFLPHMNYTPDQLKGFYMISL
LRKFLYCIFHTSRYPDRDSMVCHRILTYGKYFETLAHDELENYIGNIRNDIMNNHKNRGTYAVNIHVLTTPGLNHAFSSLL
SGKFKKSDGSYRTHPHYSWMQNISIPRSVGFYPDQVKISKMFSVRKYHPSQYLYFCSSDVPERGPQVGLVSQLSVLSSIT
NILTSEYLDLEKKICEYIRSYYKDDISYFETGFPITIENALVASLNPNMICDFVTDFRRRKRMGFFGNLEVGITLVRDHMNEI
RINIGAGRLVRPFLVVDNGELMMDVCPELESRLDDMTFSDIQKEFPHVIEMVDIEQFTFSNVCESVQKFRMMSKDERK
QYDLCDFPAEFRDGYVASSLVGINHNSGPRAILGCAQAKQAISCLSSDIRNKIDNGIHLMYPERPIVISKALETSKIAANCF
GQHVTIALMSYKGINQEDGIIIKKQFIQRGGLDIVTAKKHQVEIPLENFNNKERDRSNAYSKLESNGLVRLNAFLESGDA
MARNISSRTLEDDFARDNQISFDVSEKYTDMYKSRVERVQVELTDKVKVRVLTMKERRPILGDKFTTRTSQKGTVAYVA
DETELPYDENGITPDVIINSTSIFSRKTISMLIEVILTAAYSAKPYNNKGENRPVCFPSSNETSIDTYMQFAKQCYEHSNPKL
SDEELSDKIFCEKILYDPETDKPYASKVFFGPIYYLRLRHLTQDKATVRCRGKKTKLIRQANEGRKRGGGIKFGEMERDCLI
AHGAANTITEVLKDSEEDYQDVYVCENCGDIAAQIKGINTCLRCSKLNLSPLLTKIDTTHVSKVFLTQMNARGVKVKLDF
ERRPPSFYKPLDKVDLKPSFLV

>Protein 141:132231..132860, 209 aa

METIKALEKFMEFDRLQKDCSDKLDRERERRMKAEREIARKNCGGNPCERELESERSNVKRLEYQLDAEKEKVKFYKREL
ERDRYLSSRYLTSSSDPHEKPLPNYTFSRIKNVSPLTTEATGSVEVAPPSTDVTEPISDVTPSVDAEPEHPQLSEYQTSVSQ
VAVTPPPKPETPQIFEYQTSDSIVNNPRPFYNSDLEFDDIDMYLLPN

>Protein 142:133132..133815, 227 aa

MKPMLKQREMRRLRDRISDIERQLSDCRRNNESNADMEREMQRLRDRIMDLDRQLNECKRNGNGTSSEEVNRLKTRI
RNLKRSLEICSKDESELYSAYKTKLGRAREQISNLQESLRRERESDKTDSYYRRELTRERNKIVELEKELNKCFDAKYIDEINS
KKTRISDLERQLAACKSNGGSNGNMDQYKREIESLKRELAECRRGNNGSHSDCAYYDEEAREEVKS

>Protein 143:133775..135952, 725 aa

FIG. 14U

MEVTNLIEKCTKHSKDFATEVEKLWNDELSSESGLSRKTRNVIRNILRDITKSLTTDKKSKCFRILERSTINGEQIKDVYKTIF
NNGVDVESRINTTGKYVLFTVMTYVAAELRLIKSDEIFALLLRFFNMICDIHRKYGCGNMFVGIPAALINLLEIDHINKLFS
VFSTRYDAKTYLYTEYFLFLNINHYLLSGSDLFINVAYGAVSFSSPISVPDYIMEALTFKACDHIMKSGDLKYTYAFTKKVKD
LFNTKSDSIYQYVRLHEMSYDGVSEDTDDDDEVFAILNLSIDSSVDRYRNRVLLLTPEVASLRKEYSEVEPDYKYLMDEEV
PAYDKHLPKPITNTGIEEPHATGGDEDQPIKVVHPPNNDKDDAIKPYNPLEDPNYVPTITRTAIGIADYQLVINKLIEWLD
KCEEECGNSGEFKTELEEAKRKLTELNAELSDKLSKIRTLERDSVYKTERIDRLTKEIKEHRDIQNGTDDGSDLLEIDKKTIRE
LRESLDREREMRSELEKELDTIRNGKVDGSCQRELELSRMWLKQRDDDLRAEIDKRRNVEWELSRLRRDIKECDKYKED
LDKAKTTISNYVSKISTLESEIAKYQQDRDTLSVVRRELEEERRRVRDLESRLDECTRNQEDTQEVDALRSRIRELENKLTN
CIESGGGNLTEISRLQSKISDLERQLSECRENATEISRLQSRISDLERQLNDCRRNNETNAETERDATS

>Protein 144:135996..137504, 502 aa

MANIINLWNGIVPTVQDVNVASITAFKSMIDETWDKKIEANTCISRKHRNIIHEVIRDFMKAYPKMDENKKSPLGAPM
QWLTQYYILKNEYHKTMLAYDNGSLNTKFKTLNIYMITNVGQYILYIVFCIISGKNHDGTPYIYDSEITSNDKNFINERIKYA
CKQILHGQLTIALRIRNKFMFIGSPMYLWFNVNGSQVYHDIYDRNAGFHNKEIGRLLYAFMYYLSISGRFLNDFALLKFTY
LGESWTFSLSVPEYILYGLGYSVFDTIEKFSNDAILVYIRTNNRNGYDYVEFNKKGIAKVTEDKPDNDKRIHAIRLINDSTDV
QHIHFGFRNMVIIDNECANIQSSAENATDTGHHQDSKINIEVEDDDDVIDDDDYNPKPTPIPEPHPRPPFPRHEYHKRP
KLLPVEEPDPVKKDADRIRLDNHILNTLDHNLNFIGHYCCDTAAVDRLEHHIETLGQYAVILARKINMQSLLFPWPLPTV
HPHAIDGSIPPHGRFTIL

>Protein 145:137554..137886, 110 aa

MDGTLFPGDDDLAIPATEFFSTKAAKKPEAKREAIVKADEDDNEETLKQRLTNLEKKITNVTTKFEQIEKCCKRNDEVLFR
LENHAETLRAAMISLAKKIDVQTGRRPYE

>Protein 146:137887..138327, 146 aa

MNSLSIFFIVVATAAVCLLFIQGYSIYENYGNIKEFNATHAAFEYSKSIGGTPALDRRVQDVNDTISDVKQKWRCVVYPG
NGFVSASIFGFQAEVGPNNTRSIRKFNTMQQCIDFTFSDVINIDIYNPCVVPNINNAECQFLKSVL

>Protein 147:138328..139245, 305 aa

MQHPREENSIVVELEPSLATFIKQGFNNLVKWPLLNIGIVLSNTSTAVNEEWLTAVEHIPTMKIFYKHIHKILTREMGFLV
YLKRSQSERDNYITLYDFDYYIIDKDTNSVTMVDKPTELKETLLHVFQEYRLKSSQTIELIAFSSGTVINEDIVSKLTFLDVEV
FNREYNNVKTIIDPDFVFRSPFIVISPMGKLTFFVEVYSWFDFKSCFKDIIDFLEGALIANIHNHMIKVGNCDETVSSYNPE
SGMLFVNDLMTMNIVNFFGCNSRLESYHRFDMTKVDVELFIKALSDACKKILSASNRL

>Protein 148:139208..139441, 77 aa

MEDLNEANFSHLLINLSNNKDIDAQYASTLSVVHELLSAINFKIFNINKKSKKNSKSIEQHPVVHHAASAGREFNRR

>Protein 149:139601..139975, 124 aa

MASILNTLRFLEKTSFYNCNDSITKEKIKIKHKGMSFVFYKPKHSTVVKYLSGGGIYHDDLVVLGKVTINDLKMMLFYMDL
SYHGVTSSGAIYKLGSSIDRLSLNRTIVTKVNNYDDTFFDDDD

>Protein 150:139942..140754, 270 aa

MNCFQEKQFSRENLLKMPFRMVLTGGSGSGKTIYLLSLFSTLVKKYKHIFLFTPVYNPDYDGYIWPNHINFVSSQESLEY
NLIRTKSNIEKCIAVAQNHKKSAHFLLIFDDVGDKLSKCNTLIEFLNFGRHLNTSIILLCQTYRHVPILGRANITHFCSFNISIS

FIG. 14V

DAENMLRSMPVKGKRKDILNMLNMIQTARSNNRLAIIIEDSVFCEGELRICTDTADKDVIEQKLNIDILVNQYSHMKKNL
NAILESKKTKLCNSDQSSSSKNVSS

>Protein 151:140872..141429, 185 aa

MMTPENDEEQTSVFSATVYRDKIQGKNKRKRVIGLCIRISMVISLLSMITMSAFLIVRLNQCMSANEAAITDAAVAVAA
ASSTHRKVASSTTQYDHKESCNGLYYQGSCYILHSDYQLFSDAKANCTAESSTLPNKSDVLTTWLIDYVKDTWGSDGNPI
TKTTSDYQDSDVSQEVRKYFCVKTMN

>Protein 152:141453..141959, 168 aa

MKSLNRQTVSRFKKLSVPAAIMMILSTIISGIGTFLHYKEELMPSACANGWIQYDKHCYLDTNIKMSTDNAVYQCRKLR
ARLPRPDTRHLRVLFSIFYKDYWVSLKKTNDKWLDINNDKDIDISKLTNFKQLNSTTDAEACYIYKSGKLVKTVCKSTQSV
LCVKKFYK

>Protein 153:142003..142533, 176 aa

MDAAFVITPMGVLTITDTLYDDLDISIMDFIGPYIIGNIKTVQIDVRDIKYSDMQKCYFSYKGKIVPQDSNDLARFNIYSIC
AAYRSKNTIIIACDYDIMLDIEDKHQPFYLFPSIDVFNATIIEAYNLYTAGDYHLIINPSDNLKMKLSFNSSFCISDGNGWIII
DGKCNSNFLS

>Protein 154:142600..143226, 208 aa

MMLVPLITVTVVAGTILVCYILYICRKKIRTVYNDNKIIMTKLKKIKSSNSSKSSKSTDSESDWEDHCSAMEQNNDVDNIS
RNEILDDDSFAGSLIWDNESNVMAPSTEHIYDSVAGSTLLINNDRNEQTIYQNTTVVLNEDTKQNPNYSSNPFVNYNKT
SICSKSNPFITELNNKFSENNPFRRAHSDDYLNKQEQDHEHDDIESLV

>Protein 155:143290..144081, 263 aa

MEIFPVFGISKISNFIANNDCRYYIDTEHQKIISDEINRQMDETVLLTNILSVEVVNDNEMYHLIPHRLSTIILCISSVGGCVI
SIDNDVNGKNILTFPIDHAVIISPLSKCVVVSKGPTTILVVKADIPSKRLVTSFTNDILYVNNLSLINYLPLSVFIIRRVTDYLDR
HICDQIFANNKWYSIITIDNKQFPIPSNCIGMSSAKYINSSIEQDTLIHVCNLEHPFDLVYKKMQSYNSVPIKEQILYGRIDN
INMSISISVD

>Protein 156:144171..144344, 57 aa

MDSFSSLFMKLCCISTDKTGSKKSDKKNKNKIKDYYKITIVPGSSSTSTSSWYYTHA

>Protein 157:144341..145174, 277 aa

MSRVRISLIYLYTLVVITTTKTIEYTACNDTIIIPCTIDNPTKYIRWKLDNHDILTYNKTSKTTILSKWHTSARLHSLSDSDVSLI
MEYKDILPGTYTCGDNTGIKSTVKLVQLHTNWFNDYQTMLMFIFTGITLFLLFLEITYTSISVVFSTNLGILQVFGCVIAMI
ELCGAFLFYPSMFTLRHIIGLLMMTLPSIFLIITKVFSFWLLCKLSCAVHLIIYYQLAGYILTVLGLGLSLKECVDGTLLLSGLGT
IMVSEHFSLLFLVCFPSTQRDYY

>Protein 158:145191..145442, 83 aa

MIPLLFILFYFANGIEWHKFETSEEIISTYLLDDVLYTGVNGAVYTFSNNKLNKTGLTNNNYITTSIKVEDAEPITEIPNVGK

>Protein 159:145748..146380, 210 aa

FIG. 14W

MCLNDEGGPSSLSSHRWSTFLKVELECDIDGRSYRQIIHSRTIKTDNDTILYVFFDSPYSKSALCTYSMNTIKQSFSTSKLEG
YTKQLPSPAPGICLPAGKVVPHTTFEVIEKYNVLDDIIKPLSNQPIFEGPSGVKWFDIKEKENEHREYRIYFIKENSIYSFDTK
SKQTRSSQVDARLFSVMVTSKPLFIADIGIGVGMPQMKKILKM

>Protein 160:146406..146651, 81 aa

MNKHKTDYAGYACCVICGLIVGIIFTATLLKVVERKLVHTPSIDKTIKDAYIREDCPTDWISYNNKCIHLSTDRKNLGGRT

>Protein 161:146984..147643, 219 aa

MYSLLFIILMCIPFSFQTVYDDKSVCDSDNKEYMGIEVYVEATLDEHLRQTTCESEIHKYGASVSNGGLNISVDLLNCFLNF
HTVGVYTNRDTVYAKFASLDPWTTEPINSMTHDDLVKLTEECIVDIYLKCEVDKTKDFMKTNGNRLKPRDFKTVPPSDV
GSMIELQSDYCVNDVTAYVKIYDECGNIKQHSIPTLRDYFTTKNGQPRKILKKKFDNC

>Protein 162:147808..148209, 133 aa

MAEWHKIIEDISKNNKFEDAAIVDYKTTKNVLAAIPNRTFAKINPGEIIPLITNRNILKPLIGQKYCIVYTNSLMDENTYAM
ELLTGYAPVSPIVIARTHTALIFLMGKPTTSRRDVYRTCRDHATRVRATGN

>Protein 163:148247..148831, 194 aa

MMMMKWIISILTMSIMPVLAYSSSIFRFHSEDVELCYGHLYFDRIYNVVNIKYNPHIPYRYNFINRTLTVDELDDNVFFTH
GYFLKHKYGSLNPSLIVSLSGNLKYNDIQCSVNVSCLIKNLATSTSTILTSKHKTYSLHRSTCITIIGYDSIIWYKDINDKYNDIY
DFTAICMLIASTLIVTIYVFKKIKMNS

>Protein 164:148839..149075, 78 aa

MLLEMDKIKITVDSKIGNVVTISYNLEKITIDVTPKKKKEKDVLLAQSVAVEEAKDVKVEEKNIIDIEDDDDMDVESA

>Protein 165:149171..150211, 346 aa

MAVYAVTGGAGFLGRYIVKLLISADDVQEIRVIDIVEDPQPITSKVKVINYIQCDINDFDKVREALDGVNLIIHTAALVDVF
GKYTDNEIMKVNYYGTQTILAACVDLGIKYLIYTSSMEAIGPNKHGDPFIGHEHTLYDISPGHVYAKSKRMAEQLVMKA
NNSVIMNGAKLYTCCLRPTGIYGEGDKLTKVFYEQCKQHGNIMYRTVDDDAVHSRVYVGNAAWMHVLAAKYIQYPG
SKIKGNAYFCYDYSPSCSYDMFNLLLMKPLGIEQGSRIPRWMLKMYACKNDMKRILFRKPSLLNNYTLKISNTTFEVRTN
NAELDFNYSPIFNVDVAFERTRKWLEESE

>Protein 166:150258..150635, 125 aa

MAVCIIDHDNIRGVIYFEPVHGKDKVLGSVIGLKSGTYSLIIHRYGDISQGCDSIGSPEIFIGNIFVNRYGVAYVYLDTDVNI
FTIIGKALSISKNDQRLACGVIGISYINEKIIHFLTINENGV

>Protein 167:150625..151347, 240 aa

MAFDISVNASKTINALVYFSTQQNKLVIRNEVNDTHYTVEFDRDKVVDTFISYNRHNDTIEIRGVLPEETNIGCAVNTPVS
MTYLYNKYSFKLILAEYIRHRNTISGNIYSALMTLDDLAIKQYGDIDLLFNEKLKVDSDSGLFDFVNFVKDMICCDSRIVVAL
SSLVSKHWELTNKKYRCMALAEHISDSIPISELSRLRYNLCKYLRGHTESIEDEFDYFEDDDSSTCSAVTDRETDV

>Protein 168:151435..152169, 244 aa

FIG. 14X

MGNKNIKPSKENRLSILSKDKMDSFKRGSWATSSFKEKSRATIQRFSSLRREHIKVDHPDKFLELKRGIYEIIQKSSSIDVDK
RTKLMSNIKTMMINPFMIEGLMTSLENLDPDNKMSYSSVMILGEFDIINISDNEAAFEFINSLLKSLLLLNTRQLKLLEYSIS
NDLLYAHINALEYIIKNTFNVPERQLILRGQYLTPIFSDLLKYAGLTIKSNILMWNKQFIKPVSDLYTSIRLLYCVTV

>Protein 169:152268..152882, 204 aa

MSRGALIVFEGLDKSGKTTQCMNIMESIPANTIKYLNFPQRSTVTGKMIDDYLTRKKTYNDHIVNLLFCANRWEFASFIQ
EQLEQGITLIVDRYAFSGVAYAAAKGASMTLSKSYESGLPKPDLVIFLESGSKEINRNVGEEIYEDVTFQQKVLQEYKKMIE
EGDIHWQIISSEFEEDVKKELIKNIVIEAIHTVTGPVGQLWM

>Protein 170:152930..153418, 162 aa

MDEAYYSGNLESVLGYVSDMHTELASISQLVIAKIETIDNDILNKDIVNFIMCRSNLDNPFISFLDTVYTIIDQEIYQTELINS
LDDNEIIDCIVNKFMSFYKDNLENIVDAIITLKYIMNNPDFKTTYAEVLGSRIADIDIKQVIRKNILQLSNDIRERYL

>Protein 171:153451..155109, 552 aa

MTSLREFRKLCCDIYHASGYKEKSKLIRDFITDRDDKYLIIKLLLPGLDDRIYNMNDKQIIKLYSIIFKQSQEDMLQDLGYGYI
GDTIRTFFKENTEIRPRDKSILTLEEVDSFLTTLSSVTKESHQIKLLTDVASVCTCNDLKCVVMLIDKDLKIKAGPRYVLNAIS
PHAYDVFRKSNNLKEIIENASKQNLDSISISVMTPINPMLAESCDSVNKAFKKFPSGMFAEVKYDGERVQVHKNNNEFA
FFSRNMKPVLSHKVDYLKEYIPKAFKKATSIVLDSEIVLVDEHNVPLPFGSLGIHKKKEYKNSNMCLFVFDCLYFDGFDMT
DIPLYERRSFLKDVMVEIPNRIVFSELTNISNESQLTDVLDDALTRKLEGLVLKDINGVYEPGKRRWLKIKRDYLNEGSMA
DSADLVVLGAYYGKGAKGGIMAVFLMGCYDDESGKWKTVTKCSGHDDNTLRELQDQLKMIKINKDPKKIPEWLVVNK
IYIPDFVVEDPKQSQIWEISGAEFTSSKSHTANGISIRFPRFTRIREDKTWKESTHLNDLVNLTKS

>Protein 172:155162..156166, 334 aa

MDGVIVYCLNALVKHGEEINHIKNDFMIKPCCERVCEKVKNVHIGGQSKNNTVIADLPYMDNAVSDVCNSLYKKNVSRI
SRFANLIKIDDDDKTPTGVYNYFKPKDVIPVIISIGKDKDVCELLISSDISCACVELNSYHVAILPMNVSFFTKGNASLIILLFD
FSIDAAPLLRSVTDNNVIISRHQRLHDELPSSNWFKFYISIKSDYCSILYMVVDGSVMHAIADNRTHAIISKNILDNTTINDE
CRCCYFEPQIRILDRDEMLNGSSCDMNRHCIMMNLPDVGEFGSSMLGKYEPDMIKIALSVAGNLIRNRDYIPGRRGYSY
YVYGIASR

>Protein 173:156236..156808, 190 aa

MDIKIDISISGDKFTVTTRRENEERKKYLPLQKEKTTDVIKPDYLEYDDLLDRDEMFTILEEYFMYRGLLGLRIKYGRLFNEIK
KFDNDAEEQFGTIEELKQKLRLNSEEGADNFIDYIKVQKQDIVKLTVYDCISMIGLCACVVDVWRNEKLFSRWKYCLRAI
KLFINDHMLDKIKSILQNRLVYVEMS

>Protein 174:156943..157266, 107 aa

MTRWWRSRYICRSQCSNVKNSTCSQQILYIHLLILSYTTITKSFFKTLNHHQKSMFKVIRLKYIFEINSCISYPSILDLYIFEINS
CISHPSILDLYVLKNTILLIL

>Protein 175:157158..157556, 132 aa

MIILKDGYKEFADCMYYFLHYYIGYGRYTYSATNGSCDKGEYLDKRHNQCCNRCPPGEFAKVRCNGNDNTKCERCPPH
TYTTIPNYSNGCHQCRKCPTGSFDKVKCTGTQNSKCSCLPGWYCATDSSQTEDC

>Protein 176:157606..157785, 59 aa

FIG. 14Y

MNKEILFVNRAVLVNIATTYVIIDLIHFLHANYLNVINYDFDDNVTIHYIATWLVYYSV

>Protein 177:157975..159669, 564 aa

MNSSSKLIAVINGFRNSGRFCDINIVINDERINAHRLILSGASEYFSILFSNNFIDSNEYEVNLSHLDYQSVNDLIDYIYGIPLS
LTNDNVKYILSTADFLQIGSAITECEKYILKNLCSRNCIDFYIYADKYNNKKIESASFNTILRNILRLINDENFKYLTEESMIKILS
DDMLNIKNEDFAPLILIKWLESTQQSCTVELLRCLRISLLSPQVIKSLYSHQLVSSIYECITFLNNIAFLDESFPRYHSIELISIGI
SNSHDKISINCYNHKKNTWEMISSRRYRCSFAVAVLDNIIYMMGGYDQSPYRSSKVIAYNTCTNSWIYDIPELKYPRSNC
GGLADDEYIYCIGGIRDQDSSLTSSIDRWKPSKPYWQKYAKMREPKCDMGVAMLNGLIYVMGGIVKGDTCTDALESLS
EDGWMKHQRLPIKMSNMSTIVHDGKIYISGGYNNSSVVNVISNLVLSYNPIYDEWTKLSSLNIPRINPALWSAHNKLYV
GGGISDDVRTNTSETYDKEKDCWTLDNGHVLPRNYIMYKCEPIKHKYPLEKTQYTNDFLKYLESFIGS

>Protein 178:159719..160666, 315 aa

MTRLPILLLLISLVYATPFPQTSKKIGDDATLSCNRNNTNDYVVMSAWYKEPNSIILLAAKSDVLYFDNYTKDKISYDSPYD
DLVTTITIKSLTARDAGTYVCAFFMTSTTNDTDKVDYEEYSTELIVNTDSESTIDIILSGSTHSPETSSEKPEDIDNFNCSSVF
EIATPEPITDNVEDHTDTVTYTSDSINTVSASSGESTTDETPEPITDKEEDHTVTDTVSYTTVSTSSGIVTTKSTTDDADLYD
TYNDNDTVPPTTVGGSTTSISNYKTKDFVEIFGITALIILSAVAIFCITYYIYNKRSRKYKTENKV

>Protein 179:160811..161266, 151 aa

MEREGVDYHYVNREAIWKGIAAGNFLEHTEFLGNIYGTSKTAVNTAAINNRICVMDLNIDGVRSLKNTYLMPYSVYIRP
TSLKMVETKLRCRNTEADDEIHRRVMLAKTDMDEAGEAGLFDTIIIEDDVNLAYSKLIQILQDRIRMYFNTN

>Protein 180:161417..162319, 300 aa

MNFQGLVLTDNCKNQWVVGPLIGKGGFGSIYTTNDNNYVVKIEPKANGSLFTEQAFYTRVLKPSVIEEWKKSHNIKHV
GLITCKAFGLYKSINVEYRFLVINRLGADLDAVIRANNNRLPKRSVMLIGIEILNTIQFMHEQGYSHGDIKASNIVLDQIDK
NKLYLVDYGLVSKFMSNGEHVPFIRNPNKMDNGTLEFTPIDSHKGYVVSRRGDLETLGYCMIRWLGGILPWTKISETKN
CALVSATKQKYVNNTATLLMTSLQYAPRELLQYITMVNSLTYFEEPNYDEFRHILMQGVYY

>Protein 181:162409..163068, 219 aa

MAMFYAHALGGYDENLHAFPGISSTVANDVRKYSVVSVYNNKYDIVKDKYMWCYSQVNKRYIGALLPMFECNEYLQI
GDPIHDQEGNQISIITYRHKNYYALSGIGYESLDLCLEGVGIHHHVLETGNAVYGKVQHDYSTIKEKAKEMNALSSGPIID
YHVWIGDCICQVTAVDVHGKEIMRMRFKKGAVLQIPNLVKVKLGENDTENLSSTISAAPSR

>Protein 182:163104..163478, 124 aa

MKRLETIRHMWSVVYDHFDIVNGKECCYVHTHSSNQNPIPSTVKTNLYMKTMGSCIQMDSMEALEYLSELKESGGWS
PRPEMQEFEYPDGVEDTESIERLVEEFFNRSELQAGKLVKFGNSINC

>Protein 183:164137..165813, 558 aa

MDFFKKEILDWSVYLSLHYIARVCSNSSTSHIIQDYNLVRTYEKVDKTIVDFLSRLPNLFHILEYGENILHIYSMDDANTNIII
FFLDRVLNINKNGSFIHNLRLSSSINIKEYVYQLVNNDHPDNRIRLMLENGRRTRHFLSYISDTVNIYICILINHGFYIDAEDS
YGCTLLHRCIYHYKKSESESYNELIKILLNNGSDVDKKDTYGNTPFILLCKHDINNVELFEICLENANIDSVDFNRYTPLHYVS
CRNKYDFVKLLISKGANVNARNKFGTTPFYCGIIHGISLIKLYLESDTELEIDNEHIVRHLIIFDAVESLDYLLSRGVIDINYRTI
YNETSIYDAVSYNAYNTLVYLLNRNGDFETITTSGCTCISEAVANNNKIIMEVLLSKRPSLKIMIQSMIAITKNKQHNADLL

FIG. 14Z

KMCIKYTACMTDYDTLIDVQSLQQYKWYILKCFDEIDIMKRCYIKNKTVFQLVFCIKDINTLMRYGKHPSFVKCTSLDVYG
SRVRNIIASIRYRQRLISLLSKKLDAGDKWSCFPNEIKYKILENFNDNELSTYLKIL

>Protein 184:165917..166870, 317 aa

MKTISVVTLLCVLPAVVYSTCTVPTMNNAKLTSTETSFNDKQKVTFTCDQGYHSLDPNAVCETDKWKYENPCKKMCTV
SDYVSELYDKPLYEVNSTMTLSCNGETKYFRCEEKNGNTSWNDTVTCPNAECQPLQLEHGSCQPVKEKYSFGEYMTIN
CDVGYEVIGASYISCTANSWNVIPSCQQKCDIPSLSNGLISGSTFSIGGVIHLSCKSGFILTGSPSSTCIDGKWNPILPTCVR
SNEKFDPVDDGPDDETDLSKLSKDVVQYEQEIESLEATYHIIIVALTIMGVIFLISVIVLVCSCDKNNDQYKFHKLLP

>Protein 185:166953..167474, 173 aa

MSSSVDVDIYDAVRAFLLRHYYNKRFIVYGRSNAILHNIYRLFTRCAVIPFDDIVRTMPNESRVKQWVMDTLNGIMMN
ERDVSVSVGTGILFMEMFFDYNKNSINNQLMYDIINSVSIILANERYRSAFNDDGIYIRRNMINKLYGYASLTTIGTIAGG
VCYYLLMHLVSLYK

>Protein 186:167512..168060, 182 aa

MYKKLITFLFVIGALASYSNNEYTPFNKLSVKLYIDGVDNIENSYTDDNNELVLNFKEYTISIITESCDVGFDSIDIDVINDYKI
IDMYTIDSSTIQRRGHTCRISTKLSCHYDKYPYIHKYDGDEQQYSITAEGKCYKGIKYEISMINDDTLLRKHTLKIGSTYIFDR
HGHSNTYYSKYDF

>Protein 187:168115..168933, 272 aa

MRYIIILAVLFINSIHAKITSYKFESVNFDSKIEWTGDGLYNISLKNYGIKTWQTMYTNVPEGTYDISAFPKNDFVSFWVKF
EQGDYKVEEYCTGLCVEVKIGPPTVTLTEYDDHINLYIEHPYATRGSKKIPIYKRGDMCDIYLLYTANFTFGDSKEPVPYDI
DDYDCTSTGCSIDFVTTEKVCVTAQGATEGFLEKITPWSSKVCLTPKKSVYTCAIRSKEDVPNFKDKMARVIKRKFNKQS
QSYLTKFLGSTSNDVTTFLSMLNLTKYS

>Protein 188:169005..169178, 57 aa

MNTAISSFGIEIFGNYTQPYFQSPCFLFSLLTSSNRHGVDDRGEQKDYNQGPHLENG

>Protein 189:169020..169253, 77 aa

MRSLIIVLLFPSIIYSMSIRRCEKTEEETWGLKIGLCIIAKDFYPERTDCSVHLPTASEGLITEGNGFRDIRNTDKL

>Protein 190:169216..169716, 166 aa

MDSGIYETPINYKKSNVSAVSVNNTIFVTGGLFINNSNSTIVVNNMEKLDIYKDKQWSIIEMPMARVYHGIDSTFGMLY
FAGGLSVTEQYGNLEKNNEISCYNPRTNKWFDISYTIYKISISSLCKLNNVFYVFSKDIGYVEKYDGAWKLVHDRLPAIKAL
STSPY

>Protein 191:170073..170924, 283 aa

MESFKYCFDNDGKKWIIGNTLYSGNSILYKVRKNFTSSFYNYVMKIDHKSHKPLLSEIRFYISVLDPLTIDNWTRERGIKYL
AIPDLYGIGETDDYMFFVIKNSGRVFAPKDTESVFEACVTMINTLEFIHSRGFTHGKIEPRNILIRNKRLSLIDYSRTNKLYKS
GNSHIDYNEDMITSGNINYMCVDNHLGATVSKRGDLEMLGYCMIEWFGGKLPWKNESSIKVIKQKKEYKKFIATFFED
CFPEGNEPLELVRYIELVYTLDYSQTPNYDRLRKLFIQD

>Protein 192:171022..172059, 345 aa

FIG. 14AA

MDIFREIASSMKGENVFISPASISSVLTILYYGANGSTAEQLSKYVETEENTDKVSAQNISFKSMNKVYGRYSAVFKDSFLR
KIGDKFQTVDFTDCRTIDAINKCVDIFTEGKINPLLDEPLSPDTCLLAISAVYFKAKWLMPFEKEFTSDYPFYVSPTEMVDV
SMMSMYGKAFNHASVKESFGNFSIIELPYVGDTSMMVILPDKIDGLESIEQNLTDTNFKKWCNSLEATFIDVHIPKFKVT
GSYNLVDTLVKSGLTEVFGSTGDYSNMCNSDVSVDAMIHKTYIDVNEEYTEAAAATCALVSDCASTITNEFCVDHPFIYV
IRHVDGKILFVGRYCSPTTNC

>Protein 193:172135..172584, 149 aa

MTANFSTHVFSPQHCGCDRLTSIDDVRQCLTEYIYWSSYAYRNRQCAGQLYSTLLSFRDDAESVFIDIRELVKNMPWDD
VKDCTEIIRCYIPDEQKTIREISAIIGLCAYAATYWGGEDHPTSNSLNALFVMLEMLNYVDYNIIFRRMN

>Protein 194:172697..173677, 326 aa

MSILPIIFLPIFFYSSFVQTFNAPECIDKGQYFASFMELENEPVILPCPQINTLSSGYNILDILWEKRGADNDRIIPIDNGSN
MLILNPTQSDSGIYICITTNETYCDMMSLNLTIVSVSESNIDLISYPQIVNERSTGEMVCPNINAFIASNVNADIIWSGHRR
LRNKRLKQRTPGIITIEDVRKNDAGYYTCVLEYIYRGKTYNVTRIVKLEVRDKIIPSTMQLPDGIVTSIGSNLTIACRVSLRPP
TTDADVFWISNGMYYEEDDGDGDGRISVANKIYMTDKRRVITSRLNINPVKEEDATTFTCMAFTIPSISKTVTVSIT

>Protein 195:173723..174745, 340 aa

MSRKFMQVYEYDREQYLDEFIEDRYNDSFITSPEYYSAEKYMCRYTTLNHNCINVRRCALDSKLLHDIITNCKIYNNIELVR
ATKFVYYLDLIKCNWVSKVGDSVLYPVIFITHTSTRNLDKVSVKTYKGVKVKKLNRCADHAIVINPFVKFKLTLPNKTSHAK
VLVTFCKLRTDITQIEAPLSGNVLVYTFPDINKRIPGYIHVNIEGCIDGMIYINSSKFACVLKLHRSMYRIPPFPIDICSCCSQY
TNDDIEIPIHDLIKDVAIFKNKETVYYLKLNNKTIARFTYFNNIDTAITQEHEYVKIALGIVCKLMINNMHSIVGVNHSNTFV
NCLLEDNV

>Protein 196:174885..176609, 574 aa

MSRRLIYVLNINRKSTHKIQENEIYTYFSHCNIDHTSTELDFVVKNYDLNRRQHVTGYTALHCYLYNNYFTNDVLKILLNH
DVNVTMKTSSGRMPVYILLTRCCNISHDVVIDMIDKDKNHLLHRDYSNLLLEYIKSRYMLLKEEDIDENIVSTLLDKGIDP
NFKQDGYTALHYYYLCLAHVYKPGECRKPITIKKAKRIISLFIQHGANLNALDNCGNTPFHLYLSIEMCNNIHMTKMLLTF
NPNFKICNNHGLTPILCYITSDYIQHDILVMLIHHYETNVGEMPIDERRMIVFEFIKTYSTRPADSITYLMNRFKNINIYTRY
EGKTLLHVACEYNNTHVIDYLIRINGDINALTDNNKHATQLIIDNKENSPYTIDCLLYILRYIVDKNVIRSLVDQLPSLPIFDIK
SFEKFISYCILLDDTFYDRHVKNRDSKTYRYAFSKYMSFDKYDGIITKCHDETMLLKLSTVLDTTLYAVLRCHNSKKLRRYLN
ELKKYNNDKSFKIYSNIMNERYLNVYYKDMYVSKVYDKLFPVFTDKNCLLTLLPSEIIYEILYMLTINDLYNISYPPTKV

>Protein 197:176681..177736, 351 aa

MTMKMMVHIYFVSLLLLLFHSYAIDIENEITEFFNKMRDTLPAKDSKWLNPACMFGGTMNDIAALGEPFSAKCPPIEDS
LLSHRYKDYVVKWERLEKNRRRQVSNKRVKHGDLWIANYTSKFSNRRYLCTVTTKNGDCVQGIVRSHIKKPPSCIPKTYE
LGTHDKYGIDLYCGILYAKHYNNITWYKDNKEINIDDIKYSQTGKKLIIHNPELEDSGRYNCYVHYDDVRIKNDIVVSRCKIL
TVIPSQDHRFKLILDPKINVTIGEPANITCTAVSTSLLIDDVLIEWENPSGWLIGFDFDVYSVLTSRGGITEATLYFENVTEEY
IGNTYKCRGHNYYFEKTLTTTVVLE

>Protein 198:178468..179424, 318 aa

MEMYPRHRYSKHSVFKGFSDKVRKNDLDMNVVKELLSNGASLTIKDSSNKDPITVYFRRTIMNLEMIDIINKHTTIDERK
YIVHSYLKNYKNFDYPFFRKLVLTNKHCLNNYYNISDSKYGTPLHILASNKKLITPNYMKLLVYNGNDINARGEDTQMRTP
LHKYLCKFVYHNIEYGIRYYNEKIIDAFIELGADLTIPNNDGMIPVVYCIHSNAEYGYNNITNIKIIRKLLNLSRRASHNLFRD
RVMHDYISNTYIDLECLDIIRSLDGFDINGYFEGRTPLHCAIQHNFTQIAKYLLDRGADIVVPNTLIIHQYIQ

FIG. 14AB

>Protein 199:179436..179840, 134 aa

MEEDTNISNKVIRYNTVNNIWKTLPNFWTGTINPGVVSHKDDIYVVCDIKDEKNVKTCIFRYNTNTYNGWELVTTTESR
LSALHTILHDNTIMMLHCYESYMLQDTFNVYTREWNHMCHQHSNSYIMYNILPIY

>Protein 200:180114..181187, 357 aa

MDIFKELILKHPDENVLISPVSILSTLSILNHGAAGSTAEQLSKYIENMNENTPDDKKDDNNDMDVDIPYCATLATANKIY
GSDSIEFHASFLQKIKDDFQTVNFNNANQTKELINEWVKTMTNGKINSLLTSPLSINTRMTVVSAVHFKAMWKYPFSKH
LTYTDKFYISKNIVTSVDMMVGTENNLQYVHINELFGGFSIIDIPYEGNSSMVIILPDDIEGIYNIEKNITDEKFKKWCGML
STKSIDLYMPKFKVEMTEPYNLVPILENLGLTNIFGYYADFSKMCNETITVEKFLHTTFIDVNEEYTEASAVTGVFMTNFS
MVYRTKVYINHPFMYMIKDNTGRILFIGKYCYPQ

>Protein 201:181349..181921, 190 aa

MMIYGLIACLIFVTSSIASPLYIPVIPPITEDKSFNSVEVLVSLFRDDQKDYTVTSQFNNYTIDTKDWTIGVLSTPDGLDIPLT
NITYWSRFTIGRALFKSESEDIFQKKMSILGVSIECKKSSTLLTFLTVRKMTRVFNKFPDMAYYRGDCLKAVYVTMTYKNT
KTGETDYTYLSNGGLPAYYRNGVDG

CF33-hCD19t (OV19t): total bp: 190949 bp
5' ITR: 1-5,013 bp is underlined and identified (FIG. 15A and FIG. 15B)
3' ITR: 189,901-190,949 bp is underlined and identified (FIG. 15BG and FIG. 15BH)

5'
GAGAAAGAGATAAAAACTTTTTTACGACTCCATCAGAAAGAGGTTTAATATTTTTGTGAGACCATCGAAGAG
AGAAAGAGATAAAATTTTTTACGACTCATAGAAAGAGTTTAATATTTTGTGAGACCATCGAAGAGAGAAAG
AGAAAGAGATAGTTAGTCTAGATATTTTTCTTAGTACAAAAGTCAATGTTTTAAAATATATGGACAAGAATTT
GTCTGTATAAAAACTTGTGTGAAATTTTGTACCAAAGAAAAAATGTGAGCAGTATCCCCTACATGGATTTTA
CTAGATCATTTATATACCAAAAAAATATTATACGATCTACGTTTTATTATATGATTTTAACGTGTAAATTATAAACA
TTATTTTATGATATACAATTGTCTGGTAACCTAGATGGGCATAGGGGATGTTGATAAGCTCGACGAGTATATG
TTGTTGGACGTTATTGTTTAAGAAATAGTTGATGCATCAGAAAGAGAATAAAAAATATTTTAGTGAGACCAT
CGAAGAGAGAAAGAGAATAAAAATTTTTTACGACTCCATCAGAAAGAGGTTTAATATTTTTGTGAGACCAT
CGAAGAGAGAAAGAGATAAAATTTTTTACATCCATCAGAAAGAGTAATATTTTTGTGAGACCATCAAAGAG
AGAAAGAGAATAAAAAATTAAAATTTTTATGAGACCATCAAGAGAGAAAGAGATAAAACTTTTTTACGACT
CCATCAGAAAGAGGTTTAATATTTATGAGACCATCAAAGAAAGAGAATAAAAATATATTTTATGAGACCAT
CAAAGAGAGAAAGAGAATAAAAATATTTTGTAAAATTTTTTATGAGACCATCAAAGAGAGAAAGAGAATA
AAAATATTTTTGTAAAACTTTTTTATGAGACCATCAAAGAGAGAAAGAGAATAAAAATATTTTTGTAAAACT
TTTTTATGAGACCATCAAAGAGAGAAAGAGAATAAAAATATTTTTGTAAAACTTTTTTATGAGACCATCAA
AGAGAGAAAGAGAATAAAAATATTTTATGACTCCATTGAAGAGAGAATGAGAATAAAAATATTTTAGTGAC
ACCATCAGAAAGAGGTTTAATATTTTTGTGAGACCATCGAAGAGAGAAAGAGAATAAAAATATTTTATGAC
TCCATTGAAGAGAGAATGAGAATAAAAATATTTTAGTGACACCATCAGAAAGAGGTTTAATATTTTTTATGA
GACCATCAAAGAGAGAAAGAGAATAAAAATATTTTTGTAAAACTTTTTTATGAGACCATCAAAGAGAGAA
AGAGAATAAAAATATTTTTTGAGACCATCAAAGAGAAAGAGAATAAAAATATTTTTGTAAAACTTTTTTATG
AGACCATCAAAGAGAGAAAGAGAATAAAAATATTTTTGTAAAACTTTTTTATGAGACCATCAAAGAGAGA
AAGAGAATAAAAATATTTTTGTAAAACTTTTTTATGAGACCATCAAAGAGAGAAAGAGAATAAAAATATTTT
ATGACTCCATTGAAGAGAGAATGAGAATAAAAATATTTTGTAAAGTTTTTTTTGAGACCATCAAAGAGAG
AAAGAGAATAAAAATATTTTTGTGAGACCATCAAAGAGAGAAAGAGAATAAAAATATTTATGACTCCATG
AAGAGAGAAAGAGAATAAAAATATTTTATGAACCATCAGAAAAGAGTTTAATATTTTTTATGAGACCATCAA
AGAGAGAAAGAGAATAAAAATATTTTGTAAAACTTTTATGAGACCATCAAAGAGAGAAAGAGAATAAAAA
TATTTTATGACACCATCAGAAAGAGTTAATATTTTTATGAGACCATCAAAGAGAGAAAGAGAATAAAAATAT
TTTTTATGAGACCATCAAAGAGAGAAAGAGAATAAAAATATTTTTTATGAGACCATCAAAGAGAGAAAGA
GAATAAAAAATATTTTATGAGACCATCAAAGAGAGAAAGAGAATAAAAATATTTTTGTATGAGACCATCAAA
GAGAGAAAGAGAATAAAAATATTTTTGGTAAAACTTTTTTTATGAGACCATCAGAAAGAGGTTTAATATTTT
TGTGATACCCTGAAAGGAAATAGGAATAGTGTCATAATCGTATCACACTATTGAGACAGAAAAGAAGAAG
TCGCGAGAGGTAACTTTTTGTTTTGCAAACCGGAATATAGTGTCCGGTACACTTTTTTAATTCGTGGTGTGC
CTGAATCGTTCGATTAACCCTACTCATCCAATTTCAGATGAATAGAGTTATCGATTCAGACACACGCTTTGAG
TTTTGTTGAATCGATGAGTGAAGTATCATCGGTTGCACCTTCAGATGCCGATCCGTCGACATACTTGACCTC
AAGTTCAGATGATTCCTTGCACATGTCTCCGATACGAACGCTAAACTCTAGATTCTTGACACATTTTGTATCG
ACGATCGTTGAACCGATGATATCTTCGTAACTCACTTTCTTATGAGAGATGTTAGACCCGAGTACTGGATGG
GTCTTGATGTCGCTGTCTTTCTCTTCTTCGCTACATCTGATGTCGATAGACACCTCACAGTCTTTCCATCAGC
GGATTCTGAGATGGATTTAATCTGAGGACATTTGGTGAATCCAAAGTTCATTCTCAGACCTCCACCGATGAT
GGAGTAATAAGTGGTAGGAGGATCTACATCCTCGACTGATTCCACCTCGGGATCTGGATCTGACTCGGACT

<div align="center">*FIG.15A*</div>

CTGTAATTTCCGTTACGGATTGGCAAATCTTATCATCGGTCGGTGTTTGGTCTTGCTTTGTGACTTTGATAAT
AACATCGATTCCCATATGATGTTTGTTTTCTTCTTCCGTACACGATGAGGATGATTGCTGAAGACTGGCAGG
CACATGCATGCCAGTACGATATATTGTTTCATGATTGCTATTGATTGAGTACTGTTCTTTATGATTCTACTTCCT
TACCGTGCAATAAATTAGAATATATTTTCTACTTTTACGAGAAATTAATTATTGTATTTATGGGTGAAAAACTT
ACTATAAAAAGCGGGTGGGTTTGGAATTAGTGATCAGTTTATGTATATCGCAACTACCGGGCATATGGCTAC
ATTACCCACATGATAAGAGATTGTATCAGTTTCGTAGTCTTGAGTATTGGTATTACTATATAGTATATAGATGTC
GACGCTAGAGTTACTGTCTCCGAATGCGGCATGATAGTATCATTCTTTGCTTTCGTTAACTGTTTGGAGGAA
GAATCTTTGTTATTGCATTTAATCTCGAAATTCAGAGTGCACACCTTTCTCCTGTAAAGAATCCTGAAGTTGC
TACCTTATTAAGAACGGAGAAGTATCCATCACGAAAGACGGGATTACAGTCTTTATGATTCATAGTAATAGTT
AGTTCCGACGTTGAGATGGATTCGCTGAGACCGGTAGTGGTCGTCCGAGTACACGATGTGTCGTTGACGG
GATACAGATTAATTTCCACATCGATATAGTTAAAGGTATTTCTGGGTACGGGTTTGAGATCGTCGTACATGG
GAAATGAAATGTGACTGTCTGAATGTATGGCTTTAAGATAGCTGTGATACCGTATACAGGTCGGTGTCGGA
GATTCGAATCTCTTTAAGGCGACTTATGTCACGATGATGGAATCTATCTTATCGAATGATATATTTTTCATAAA
TACACTTTTATAGTCCTCGTTTAAACAGAATTTACTATGTAGTTCCGCGAATGACTCGTCCCTTAATAGGCAG
TAGGCTAGTATCTTTTTTACGTAGTAATCGTCGTAGGGAGAGACATCTTGTAGAACAACGATTTAATCATAG
GTAGAGATACTTTCAGTCTGTGGTGGATGATGTCATTCACAACATCCGCCTTGTATATGATGTTTCTGTTTTC
AAACACCAAGTCGAATACCGTCTTTAGTCGGAAGGTTGATGTCGTATCCGATGTATGAGGCAACATTGTTGT
TACAATTTTGAAAGGCGGTATTATAGTATTCGTCTTTCTGAATGTCGAACCTATCTAGTAGATACCGTAGTATA
TTGAGAGTGTATCCTTGATTATGTTTATGAATAGATAAAGTAGATGTTGTCCTTCTTCCTTTTGTTCGTGCCA
ATTGAGTAACATTATGAGAATATGACCTGTTGCACAATCGTTCCATGATGGGTGTACAATCAAGATTATTACG
TATCCTCGTATCGGCTCCTCGAGATAAAAGAGCATACACCACACGAGGACTATGTTTGGTATACTGTTGAAG
GTAAGTGTGTAACCGCGTTAATGTTTGCTCCATAATCTATTATCGCGTAGATGAATCGCTTCTCGGCTCGCAT
CTTAGTGTGACTTAACTTGTAATAATTGCTTTTGTAGAACGTGGATATGTGTTTACAGTAGTAATGAAGAGA
AGTGAGTCCATCCTCGTCGACGCAATTAGGGTCGGATCCTTTGTACAGAACGTAATAGTTTAAGCTCCCATT
GAATTTATATCTAAGATAACACAGCAATAGATCGGATGATTTACTAAAGTCATCAATGGTGTCCGTTAGTATAT
CAAAGATCTTGTTATCGATTGATAGTGAATGAATCAGATAGTGGTGTAGAGGAATATGTCCTTTTTCATCCTT
GCTATCAAAGTTACGCATGCCGTGGTGTAACAATATCTTTAATACAGATGGATTAAATCGTGTATTCATCGTAT
AGCAATGTAATGGAGAGTTACCTCGTTTATTCAGATCGCAGTGTTTAATAACTAGCTTAAACAGATGAGACG
ATGTATCCACATCAAAGAACGTAAAATACATATGACAAACATTGTTGACAGAAACGTGACCTTCATTCTTACC
GTCGTCCATAAATACGTTAGGTATGTACCACATACTGTCGCGAACGATGCGTACAATCTCGTCCATCTCATAA
TGATTTACTTTTTCATAATTAAAGATGTGAAAGAAAAACAGAACAATATATTTTTTAGTAATGTTTATGCGA
GACATATAAAATAAACTCCGTGTTTATGA
TCATTTTTAACAGCAACACATTCAATATTGTATTGTTATTTTTATATTATTTACACAATTAACAATATATTATTAG
TTTATATTACTGAATTAATAATATAAAATTCCCAATCTTGTCATAAACACACACTGAGAAACAGCATAAACACA
AAATCCATCAAAAATGTCGATGAAATATCTGATGTTGTTGTTCGCTGCTATGATAATCAGATCATTCGCCGATA
GTGGTAACGCTATCGAAACGACATCGCCAGAAATTACAAACGCTACAACAGATATTCCAGCTATCAGATTAT
GCGGTCCAGAGGGAGATGGATATTGTTTACACGGTGACTGTATCCACGCTAGAGATATTGACGGTATGTATT
GTAGATGCTCTCATGGTTATACAGGCATTAGATGTCAGCATGTAGTATTAGTAGACTATCAACGTTCAGAAAA
CCCAAACACTACAACGTCATATATCCCATCTCCCGGTATTATGCTTGTATTAGTAGGCATTATTATTATTACGTG
TTGTCTATTATCTGTTTATAGGTTCACTCGACGAACTAAACTACCTATACAAGATATGGTTGTGCCATAATTTT
TATAAATTTTTTTATGAGTATTTTTACAAAAAAATGTATAAAGTGTATGTCTTATGTATATTTATAAAAATGCT
AAGTATGCGATGTATCTATGTTATTTGTATTTATCTAAACAATACCTCTACCTCTAGATATTATACAAAAATTTTT
TATTTCGGCATATTAAAGTAAAATCTAGTTACCTTGAAAATGAATACAGTGGGTGGTTCCGTATCACCAGTAA
GAACATAATAGTCGAATACAGTATCCGATTGAGATTTTGCATACAATACTAGTCTAGAAAGAAATTTGTAATC

*FIG.15B*

ATCTTCTGTGACGGGAGTCCATATATCTGTATCATCGTCTAGTTTATCAGTGTCCCATGCTATATTCCTGTTATC
ATCATTAGTTAATGAAAATAACTCTCGTGCTTCAGAAAAGTCAAATATTGTATCCATACATACATCTCCAAAAC
TATCGCTTATACGTTTATCTTTAACGATACCTATACCTAGATGGTTATTTACTAACAGACATTTTCCAGATCTAT
TGACTATAACTCCTATAGTTTCCACATCAACCAAGTAATGATCATCTATTGTTATATAACAATAACATAACTCTT
TTCCATTTTTATCAGTATGTATATCTATATCAACGTCGTCGTTGTAGTGAATAGTAGTCATTGATCTATTATATGA
AACGGATATGTCTAGAACGGCAATTGTTTTACGTCCAGTTAACACTTTCTTTGATTTAAAGTCTAGAGTCTTT
GCAAACATAATATCCTTATCCGACTTTATATTTCCTGTAGGGTGGTATAATTTTATTTTGCCTCCACATATCGGT
GTTTCCAAATATATTACTAGACAATATTCCATATAGTTATTAGTTAAGGGTACCCAATTAGAACACGTACGCTT
ATTATCATCATTTGGATCGTATTTCATAAAAGTTATTGTACTATCGATGTCAACACATTCTACATTTTTTAATCG
TCTATATAGTATTTTTCTGATATTTTCTATAATATCAGAATTGTCTTCCATCGGAAGTTGTATACTATCGGAATCA
GTTACATGTTTAAATAATTCTCTGATGTCATTCCTTATACAATCAAATTCATTATTAAACAGTTTAATAGTCTGT
AGACCTTTATCGTCGTAAATATCCATTGTCTTATTAGTTACGCTTATTTTTATGTGTTTTACGTTGCTTTATTATA
TTTTATAAGAATGATTGTTTGACGAATCACGAGAACTATTAAGACACATTATTAGGTATATATTATAAAAAAGT
TTTTGATTACGATGTTATAAGAGGAAAGAGGACACATTAACATCATACATCAATTAACTACATTCTTATAACAT
CGTAATCAAAAGAATTGCAATTTTGATGTATAACAACTGTCAATGGGTTATGGAATTGTATATTACATATTATA
CGGTATGTTGGTAACGACAAATACCGATCGGTAATTGTCTGCCGGTGTAATAGAATTATATATATCTATCTATT
ACACCGGCTGAGTATGCATAATAATAAGTTGTGGTAGTATGATCTCCATATTTATAATTTAGGACTTTGTATTC
AGTATTTTTGGAATCATAAAAAATAAAAAAAAGTTTTACTAATTTAAAATTTAAAAAGTATTTACATTTTTTTC
ACTGTTTAGTCGCGGATATGGAATTCGATCCTGCCAAAATCAATACATCATCTATAGATCATGTAACAATATTA
CAATACATAGATGAACCAAATGATATAAGACTAACAGTATGCATTATCCGAAATATTAATAACATTACATATTAT
ATCAATATCACAAAAATAAATACACATTTGGCTAATCAATTTCGGGCTTGGAAAAAACGTATCGCCGGAAGG
GACTATATGACTAACTTATCTAGAGATACAGGAATACAACAATCAAAACTTACTGAAACTATACGTAACTGTC
AAAAAAATAGAAACATATATGGTCTATATATACACTACAATTTAGTTATTAATGTGGTTATTGATTGGATAACC
GATGTGATTGTTCAATCAATATTAAGAGGGTTGGTAAATTGGTACATAGCTAATAATACCTATACTCCAAATAC
ACCCAATAATACAACAACCATTTCTGAGTTGGATATCATCAAAATACTGGATAAATACGAGGACGTGTATAGA
GTAAGTAAAGAAAAAGAATGTGGAATTTGCTATGAAGTTGTTTACTCAAAACGATAGATACTTTGGTTTATT
GGATTCGTGTACTCATATATTTTGCATAACATGCATCAATATATGGCATAAAACACGAAGAGAAACCGGTGC
GTCGGATAATTGTCCTATATGTCGTACCCGTTTTAGAAACATAACAATGAGCAAGTTCTATAAGCTAGTTAAC
TAATAAATAAAAAGTTTAATTTGTTGACGACGTATGTCGTTATTTTTCTCGTATGAAAGATTAAATTCAATTCA
ATTCGTTGTTTCTAATATAATCTGCCGTATTGGATGGATTCTCAAGACAATTGCATTTAGATTATATTATCATGA
ATAAAAATAGTAGCACGCACTACTTCAGCCAAATATTCTTTTTTGAAACGCCATCTATCGTAGTGAGGACAC
AAGTGAACCTATAATTATCAAATTTATTAGTATCAGTCACATGAAGGACTTTCTGTAGAGTGACGATTCTACC
ATCTATGGTACTAACGGTTTCATCCTCCTTGATACCCTCACCCAAATGTTCTATAAATTTAGCATCCTCGTCCG
ATCTCATATCCTTTGCCAACCAATACATGTAGCTAAAATTAGGCATAAATTTCACACATCCAGTGCAACGAAA
TTCTCCAGAAGATGTTACGATGTTTAGGTTAGGACATTTGATTTCGTCGGCATTAACATATGGGTGAACACA
CCCATACATGAAAGCGATGAGAAATAGGATTCTCATCTTGCCAAAATATCACTAGAAAAAATTTATTTATCAA
TTTTAAAGGTATAAAAAATACTTATTGTTGCTCGAATATTTTGTATTTGATGGTATACGGAAGATTAGAAATGT
AGGTATTATCATCAACTGATTCTATGGTTTTATGTATTCTATCATGTTTCACTATTGCGTCGGAAATAATATCAT
ATGCTTCCACATATATTTTATTTTGTTTAACTCATAATACTCACGTAATTCTGGATTATTGGCATATCTATGAAT
AATTTTAGCTCCATGATCAGTAAATATTAATGAGAACATAGTATTACCACCTACCATTATTTTTTTCATTTCGTT
CAATTCTTGATTGCAAAGATCTATATAATCATTATAGCGTTGACTTATGGACTCTGGAATCTTAGACGATGTAC
AGTCATCTATAATCATGGCATATTTAATACATTGTTTTATAGCATAGTAGTTATCTACGATGTTAGATATTTCTCT
CAATGAATCAATCACACAATCTAATGTAGGTTTATGACATAATAGCATTTTCAGCAGTTCAATGTTTCTAGATT
CGTTGATGGCAATGGCTATACATGTATATCCGTTATTTGATCTAATGTTGACATCTGAACCGGATTCTAGCAGT

*FIG.15C*

```
AAAGATACTAGAGATTGTTTATTATATCTAACAGCCTTGTGAAGAAGTGTTTCTCCTCGTTTGTCAATCATGT
TAATGTCTTTAAGATAAGGTAGGCAAATGTTTATAGTACTAAGAATTGGGCAAGCATAAGACATGTCACAAA
GACCCTTTTTGTATGTATAAGTGTAAAAATTATAACATTCATAGTTGGATTTACATAGGTGTCCAATCGGGATC
TCTCCATCATCGAGATAATTGATGGCATCTCCCTTCCTTTTTTAGTAGATATTTCATCGTGTAAGAATCAATATT
AATATTTCTAAAGTATTCGTGTATAGCCTCTTTATTTACCACAGTTCCATATTCCACTAGAGGATATCGCCGAA
TGTCATATACTCAATTAGTATATGTTGGAGGACATCCGAGTTCATTGTTTTCAATATCAAAAAGATGGTTTCCT
TATCATTTCTCCATAGTGGTACAATACTACACATTATTCCGTGCGGCTTTCCATTTTCCAAAAACAATTTGACC
AAATCTAAATCTACATCTTTATTGTATCTATAATCACTATTTAGATAATCAGCCATAATTACTCGAGTGCAACAT
GTTAGATCGTCTATATATGAATAAGCAGTGTTATCTATTCCTTTCATTAACAATTTAACGATGTCTATATCTATAT
GAGATGACTTAATATAATATTGAAGAGCTGTACAATAGTTTTTATCTATAGAAGACGGCTTGATTCCGTGATT
AATTAGACATTTAACAACTTCCGGACGCACATATGCTCTCGTATCCGACTTTGAATACAGATGAGAGATGAT
ATACAGATGCAATACGGTACCGCAATTTCGTAGTTGATAATCATCATACGCGTATCAGTACTCGTCCTCATAAA
GAACACTGCAGCCATTTTCTATGAACAAATCAATAATTTTAGGAACAGGATCATTGTCATTACATAATTTTCT
ATAACTGAACGATGGTTTTCACATTTAACACTCAAGTCAAATCCATGTTCTACCAACACCTTTATCAAGTCAA
CGTCTACATTTTTGGATTTCATATAGCTGAATATATTAAAGTCATTTATGTTGCTAAATCCAGTGGCTTCTAGTA
GAGCCATCGCTATATCCTTTAACTTTAACATGTCTACTATTTGTGTATTCTTCTAATGGGTAGCTGTCTCCAATT
TTTGCGTAATGGATTAGTGCCACTGTCTAGTAGTAGTTTGACGACCTCGACATTATTACAATGCTCATTAAAA
AGGTATGCGTGTAAAGCATTATTCTTGAATTGGTTCCTGGTATCATTAGGATCTCTGTCTCTCAACATCTGTTT
AAGTTCATCGAGAGCCACCTCCTCATTTTCCAGATAGTCAAACATTTTGACTGAATGAGCTACTGTGAACTC
TATACACCCACACAACTAATGTCATTAAATATTATTTTTTGAATGTATTTATACCATGTCAAAAACTTGTACAAT
TATTAATAAAAATAATTTAGTGTTTAAATTTTACCAGTTCCAGATTTTACACCTCCGTTAACCCCACTTTTTAC
ACCACTGGACGATCCTCCTCCCCACATTCCACCGCCACCAGATGTATAAGTTTTAGATCCTTTATTACTACCAT
CATGTCCATGGATAAAGACACTCCACATGCCGCCACTACTACCCCCTTTAGAAGACATATTAATAAGACTTAA
GGACAAGTTTAACAATAAAATTAATCACGAGTACCCTACTACCAACCTACACTATTATATGATTATAGTTTCTA
TTTTTACAGTACCTTAACTAAAGTCTCTAGTCACAAGAGCAATACTACCAACCTACACTATTATATGATTATAG
TTTCTATTTTTATAGGAACGCGTACGAGAAAATCAAATGTCTAATTTCTAACGGTAGTGTTGATAAACGATTA
TCGTCAATGGATACCTCCTCTATCATGTCGTCTATTTTCTTACTTTGTTCTATTAACTTATTAGCATTATATATTAT
TTGATTATAAAACTTATATTGCTTATTAGCCCAATCTGTAAATATCGGATTATTAACATATCGTTTCTTTGTAGG
TTTATTTAACATGTACATCACTGTAAGCATGTCCGTACCATTTATTTTAATTTGACGCATATCCGCAATTTCTTT
TTCGCAGTCGGTTATAAATTCTATATATGATGGATACATGCTACATGTGTACTTATAATCGACTAATATGAAGTA
CTTGATACATATTTTCAGTAACGATTTATTATTACCACCTATGAATAAGTACCTGTGATCGTCTAGGTAATCAA
CTGTTTTCTTAATACATTCGATGGTTGGTAATTTACTCAGAATAATTTCCAATATCTTAATATATAATTCTGCTAT
TTCTGGATATATTTATCTGCCAGTATAACACAAATAGTAATACATGTAAACCCATATTTTGTTATTATATTAATGT
CTGCGCCATTATCTATTAACCATTCTACTAGGCTGACACTATGCGACTTAATACAATGATAAAGTATACTACAT
CCATGTTTATCTATTTTGTTTATATCATCAATATACGGCTTACAAAGTTTTAGTATCGATAACACATCCAACTCA
CGCATAGAGAAGGTAGGGAATAATGGCATAATATTTATTAGGTTATCATCATTGTCATTATCTACAACTAAGTT
TCCATTTTTTAAAATATACTCGACAACTTTAGGATCTCTATTGCCAAATTTTTGAAAATATTTATTTATATGCTT
AAATCTATATAATGTAGCTCCTTCATCAATCATACATTTAATAACATTGATGTATACTGTATGATAAGATACATAT
TCTAACAATAGATCTTGTATAGAATCTGTATATCTTTTAAGAATTGTGGATATTAGGATATTATTACGTAAACTA
TTACACAATTCTAAAATATAAAACGTATCACGGTCGAATAATAGTTGATCAACTATATAATTATCGATTTTGTG
ATTTTTCTTCCTAAACTGTTTACGTAAATAGTTAGATAGAATATTCATTAGTTCATGACCACTATAGTTACTATC
GAATAACGCGTCAAATATTTCCCGTTTAATATCGCATTTGTCAAGATAATAATAGAGTGTGGTATGTTCACGA
TAAGTATAATAACGCATCTCTTTTTTGTGTGAAATTAAATAGTTTATCACGTCCAAAGATGTAGCATAACCATC
TTGTGACCTAGTAATAATATAATAATAGAGAACTGTTTTACCCATTCTATCATCATAATCAGTGGTGTAGTCGT
```

<div style="text-align:center">*FIG.15D*</div>

AATCGTAATCGTCTAATTCATCATCCCAATTATAATATTCACCAGCACGTCTAATCTGTTCTATTTTGATCTTGT
ATCCATACTGTATGTTGCTACATGTAGGTATTCCTTTATCCAATAATAGTTTAAACACATCTACATTGGGATTTG
ATGTTGTAGCGTATTTCTCTACAATATTAATACCATTTTTGATACTATTTATTTCTATACCTTTCGAAATTAGTAA
TTTCAATAAGTCTATATCGATGTTATCAGAACATAGATATTCGAATATATCAAAATCATTGATATTTTTATAGTC
GACTGACGACAATAACAAAATCACAACATCGTTTTTGATATTATTATTTTTCTTGGTAACGTATGCCTTTAATG
GAGTTTCACCATCATACTCATATAATGGATTTGCACCACTTTCTATCAATGATTGTGCACTGCTGGCATCGATG
TTAAATGTTTTACAACTATCATAGAGTATCTTATCGTTAACCATGATTGGTTGTTGATGCTATCGCATTTTTTG
GTTTCTTTCATTTCAGTTATGTATGGATTTAGCACGTTTGGGAAGCATGAGCTCATATGATTTCAGTACTGTA
GTGTCAGTACTATTAGTTTCGATCAGATCAATGTCTAGATCTATAGAATCAAAACACGATAGGTCAGAAGATA
ATGAATATCTGTACGCTTCTTTTTGTACTGTAACTTCTGGTTTTGTTAGATGGTTGCATCGTGCTTTAACATCA
ATGGTACAAATTTTATCCTCGCTTTGTGTATCATATTCGTCTCTAGTATAAAATTCTATATTCAGATTATCATGCG
ATGTGTATACGCTAACGGTATCAATAAACGGAGCACACCATTTAGTCATAACAGTAATCCAAAATTTTTTAAA
GTATATCTTAACGAAAGAAGTTGTGTCATTGTCTACGGTGTATGGTACTAGATCCTCATAAGTGTATATATCTA
GAGTAATGTTTAATTTATTAAATGGTTGATAATATGGATCCTCATGACAATTTCCGAAGATGGAAATGAGATA
TAGACATGCAATAAATCTAATCGAAGACATGGTTACTCCTTAAAAAAAATACGAATAATCACCTTGGCTATTTA
GTAAGTGTCATTTAACACTATACTCATATTAATCCATGGACTCATAATCTCTATACGGGATTAACGGATGTTCT
ATATACGGGGATGAGTAGTTTTCTTCTTTAACTTTATACTTTTTACTAATCATATTTAGACTGATGTATGGGTA
ATAGTGTTTAAAGAGTTCGTTCTCATCATCAGAATAAATCAATATCTCTGTTTTTTTGTTATACAGATGTATTAC
AGCCTCATATATTACGTAATAGAACGTGTCATCTACCTTATTAACTTTCACCGCATAGTTGTTTGCAAATACGG
TTAATCCTTTGACCTCGTCGATTTCCGACCAATCTGGGCGTATAATGAATCTAAACTTTAATTTCTTGTAATCA
TTCGAAATAATTTTTAGTTTGCATCCGTAGTTATCCCCTTTATGTAACTGTAAATTTCTCAACGCGATATCTCC
ATTAATAATGATGTCGAATTCGTGCTGTATACCCATACTGAATGGATGAACTAACGAATATCAACGGCGTTAA
TAGTAATTTACTTTTTCATCTTTACATATTGGGTACTAGTTTTACTATCATAAGTTTATAAATTCCACAAGCTAC
TATGGAATAAGCCAACCATCTTAGTATACCACACATGTCTTAAAGTTTATTAATTAATTACATGTTGTTTTATAT
ATATCGCTACGAATTTAAAGAGAAATCAGTTTAGGAAGAAAAAAATTATCTATCTACATCATCACGTCTCTGT
ATTCTACGATAGAGTGCTACTTTAAGATGAGACATATCCGTGTCATCAAAAATATACTCCATTAAAATGATTAT
TCCGGCAGCGAACTTGATATTGGATATATCACAACCTTTGTTAATATCTACGACAATAGACAGCAGTCCCATG
GTTCCATAAACAGTGAGTTTATCTTTCTTTGAAGCGATAGTTTGTAGAGATCTTATAAAACCGTCAAACGAC
ATCGCATTTATATCTTTAGCTAATTCATATATGTTACCATCGTAATATCTAACCGCGTCTATCTTAAACGTTTCCA
TCGCTTTAAAGACGTTTCCGATAGATGGTCTCATTTCATCAGTCATACTGAGCCAACAAATATAATCGTGTAT
AACATCTTTGATAGAATCAGACTCTAAAGAAAACGAATCGGCTTTATTATACGCATTCATGATAAACTTAATG
AAAAATGTTTTTCGTTGTTTAAGTTGGATGAATAGTATGTCTTAATAATTGTTATTATTTCATTAATTAATATTT
AGTAACGAGTACACTCTATAAAAACGAGAATGACATAACTAGTTATCAAAGTGTCTAGGACGCGTAATTTTC
ATATGGTATAGATCCTGTAAGCATTGTCTGTATTCTGGAGCTATTTTCTTTATCGCATTAGTAAGTTCAGAATA
TGTTATAAATTTAAATCGAATAACGAACATGACTTTAGTAAAGTCGTCTATATTAACTCTTTTATTTTCTAGCC
ATCGTAATACCATGTTTAAGATAGTATATTCTCTAGTTACTACGATCTCATCGTTGTCTAGAATATCACATACTG
AATCTACATCCAATTTTAGAAATTGGTCTGTGTTACATATCTCTTCTATATTATTGTTGATGTATTGTCGTAGAA
AACTATTACGTAGACCATTTTCTTTATAAAACGAATATATAGTACTCCAATTATCTTTACCGATATATTTGCACA
CATAATCCATTCTCTCAATCACTACATCTTTAAGATTTTCGTTGTTAAGATATTTGGCTAAACTATATAATTCTAT
TAGATCATCAACAGAATCAGTATATATTTTTCTAGATCCAAAGACGAACTCTTTGGCGTCCTCTATAATATTCC
CAGAAAAGATATTTTCGTGTTTTAGTTTATCGAGATCTGATCTGTTCATATACGCCATGATTGTACGGTACGTT
ATGATAACCGCATAAAATAAAAATCCATTTTCATTTTTAACCAATACTATTCATAATTGAGATTGATGTAATACT
TTGTTACTTTGAACGTAAAGACAGTACACGGATCCGTATCTCCAACAAGCACGTAGTAATCAAATTTGGTGT
TGTTAAACTTCGCAATATTCATCAATTTAGATAGAAACTTATACTCATCATCTGTTTTAGGAATCCATGTATTAT

*FIG.15E*

TACCACTTTCCAACTTATCATTATCCCAGGCTATGTTTCGTCCATCATCGTTGCGCAGAGTGAATAATTCTTTT
GTATTCGGTAGTTCAAATATATGATCCATGCATAGATCGGCAAAGCTATTGTAGATGTGATTTTTCCTAAATCT
AATATAAAACTCGTTTACTAGCAAACACTTTCCTGATTTATCGACCAAGACACATATGGTTTCTAAATCTATCA
AGTGGTGGGGATCCATAGTTATGACGCAGTAACATAGATTATTACATTCTTGACTGTCGCTAATATCTAAATAT
TTATTGTTATCGTATTGGATTCTGCATATAGATGGCTTGTATGTCAAAGATATAGAACACATAACCAATTTATA
GTCGCGCTTTACATTCTCGAATCTAAAGTTAAGAGATTTAGAAAACATTATATCCTCGGATGATGTTATCACT
GTTTCTGGAGTAGGATATATTAAAGTCTTTACAGATTTCGTCCGATTCAAATAAATCACTAAATAATATCCCAC
ATTATCATCTGTTAGAGTAGTATCATTAAATCTATTATATTTTATGAAAGATATATCACTGCTCACCTCTATATTT
CGTACATTTTTAAACTGTTTGTATAATATCTCTCTGATACAATCAGATATATCTATTGTGTCGGTAGACGATACC
GTTACATTTGAATTAATGGTGTTCCATTTTACAACTTTTAACAAGTTGACCAATTCATTTCTAATAGTATCAAA
CTCTCCATGATTAAATATTTTAATAGTATCCATTTTATATCACTACGGACACAAAGTAGCTGACATAAACCATT
GTATAATTTTTATGTTTTATGTTTATTAGCGTACACATTTTGGAAGTTCCGGCTTCCATGTATTTCCTGGAGAG
CAAGTAGATGATGAGGAACCAGATAGTTTATATCCGTACTTGCACTTAAAGTCTACATTGTCGTTGTATGAGT
ATGATCTTTTAAACCCGCTAGACAAGTATCCGTTTGATATTGTAGGATGTGGACATTTAACAATCTGACACGT
GGGTGGATCGGACCATTCTCCTCCTGAACACAGGACACCAGAGTTACCAATCAACGAATATCCACTATTGC
AACTATAAGTTACAACGCTCCCATCGGTATAAAAATCCTCGTATCCGTTATGTCTTCCGTTGGATATAGATGGA
GGGGATTGGCATTTAACAGATTCACAAATAGGTGCCTCGGGATTCCATACCATAGATCCAGTAGATCCTAAT
TCACAATACGATTTAGATTCACCGATCAACTGATATCCGCTATTACAAGAGTACGTTATACTAGAGCCAAAGT
CTACTCCGCCAATATCAAGTTGGCCATTATCGATATCTCGAGGCGATGGGCATCTCCGTTTAATACATTGATT
AAAGAGTGTCCATCCAGTACCTGTACATTTAGCATATATAGGTCCCATTTTTTGCTTTCTGTATCCAGGTAGA
CATAGATATTCTATAGTGTCTCCTATGTTGTAATTAGCATTAGTTTCCACACTATTCTTAAATTTTATATTAATGG
GACGTGAAGGAATAGGACAGTATGATAGAACGCATCCTATTCCCAACAATGTCAGGAACGTCACGCTCTCC
ACCTTCATATTTATTTATCCGTAAAAATGTTATCCTGGACATCGTACAAATAATAAAAAAGCCCATATATGTTTG
CTATTGTAGAAATTGTTTTTCACAGTTGCTCAAAAACGATGGCAGTGACTTATGAGTTTCATCTTTAGTAAAC
ATATCATAATATTCGATATTACGAGTTGACATATCGAACAAATTCCAAGTATTTGATTTTGGATAATATTCGTAT
TTTGCATCTGCTATAATTAAGATATAATCACCGCAAGAACACACGAACATCTTTCCTACATGGTTAAAGTACA
TGTATAATTCTATCCATTTGTCTTCCTTAACTATATATTTGTATAGATAATTACGAGTCTCATAAGTAATTCCAGT
AATTGCATAGATGTCACCATCGTACTCTACAGCATAAACTATACTATGATGTCTAGGCATGGGAGACTTTTTT
ATCCAACGATTTTTAGTGAAACATTCTACATCGTTTAATACTACATATTTCTCATACGTGGTATAAACTCCACC
CATTACATATATATCATCGTTTACGAATACCGACGCGCCTGAATATCTAGGAGTAATTAAGTTTGGAAGTCTTA
TCCATTTCGAAGTGCCGTGTTTCAAATATTCTGCCACACCCGTTGAAATAGAAAATTCTAATCCTCCTATTAC
ATATAACTTTCCATCGTTAACACAAGTACTAACTTCTGATTTTAACGACGACATATTAGTAACCGTTTTCCATT
TTTTCGTTTTAAGATCTACCCGCGATACGGAATAAACATGTCTATTGTTAATCATGCCGCCAATAATGTATAGA
CAATTATGTAAAACATTTGCATTATAGAATTGTCTATCTGTATTACCGACTATCGTCCAATATTCTGTTCTAGGA
GAGTAATGGGTTATTGTGGATATATAATCAGAGTTTTTAATGACTACTATATTATGTTTTATACCATTTCGTGTC
ACTGGCTTTGTAGATTTGGATATAGTTAATCCCAACAATGATATAGCATTGCGCATAGTATTAGTCATAAACTT
GGGATGTAAAATGTTGATGATATCTACATCGTTTGGATTTTTATGTATCCACTTTAATAATATCATAGCTGTAAC
ATCCTCATGATTTACGTTAACGTCTTCGTGGGATAAGATAGTTGTCAGTTCATCCTTTGATAATTTTCCAAATT
CTGGATCGGATGTCACCGCAGTAATATTGTTGATTATTTCTAACATCGACGCATTATATAGTTTTTTAATTCCAT
ATTGTTTAGAAAAGTTAAACATCCTTATACAATTTGTGGAATTAATATTATGAATCATAGTTTTTACACATAGA
TCTACTACAGGCGTAACATCAATTATTACGGCAGCAACTAGTATCATTTCTACATTGTTTATGGTGATGTTTAT
CTTCTTCCAGCGCATATAGTCTAATAGCGATTCAAACGCGTGATAGTTTATACCATTCAATATAATCACTTCAT
CATTTATATGGTGCTCCTGAATGCGTTTAAAAAAATTATACGGAGACGCCGTAATAATTTCCTTATTCACTTGT
ATAATTTCCCCATTGATAGAAAATATCACGCTTTCCATTCTTGAAGTACTATAAGTAATTATAGTATAATGTAAA

*FIG.15F*

CGTTTATATATTCAATATTTTTATAAAAATCATTTTGACATTAATTCCTTTTTAAATTTCCGTCTATCATCTATAGA
AACGTATTCTATGAATTTATAAAATGCTTTTACGTGTCCTATCGTAGGCGATAGAACCGCTAAAAAGCCTATC
GAATTTCTACAAAAGAATCTATTATATGGTATAGGGAGAGTATAAAACATTAAATGCCCGTACTTATTAAAGT
ATTCAGTAGCCAATCCTAACTCTTTCGAATACTTATTAATGGCTCTTGTTCTGTACGAATCTATTTTTTTGAAC
AACGGACCTAGTGGTATATCTTGTTCTATGTATCTAAAATAATGTCTGACTAGATCCGTTAGTTTAATATCCTC
AGTCATCTTGTCTAGAATGGCAAATCTAACTGCGGGTTTAGGCTTTAGTTTAGTTTTTATATCTACATCTATGT
CTTTATCTAACACCAAAAATATAATAGCTAATATTTTATTACAATCATCCGGATATTCTTCTACGATCTCACTAA
CTAATGTTTCTTTGGTTATACTAGTATAGTCACGATCAGACAAATAAAGAAAATCAGATGATCGATGAATAAT
ACATTTAAATTCATCATCTGTAAGATTTTTGAGATGTCTCATTAAAATATTATTAGGGTTAGTACTCATTATCAT
TCGGCAGCTATTACTTATTTTATTATTTTTCACCATATAGATCAATCATTAGATCATCAAAATATGTTTCAATCAT
CCTAAAGAGTATGGTGAATGACTCTTCCCATCTAATTTCTGAACGTTCACCAATGTCTCTAGCCACTTTGGCA
CTAATAGCGATCATTCGCTTAGCGTCTTCTATATTATTAACTGGTTGATTCAATCTATCTAGCAATGGACCGTC
GGACAGCGTCATTCTCATGTTCTTAATCAATGTACATACATCGCCGTCATCTACCAATTCATCCAACAACATAA
GCTTTTTAAAATCATCATTATAATAGGTTTGATCGTTGTCATTTCTCCAAAGAATATATCTAATAAGTAGAGTC
CTCATGATTAGTTAACAACTATTTTTTATGTTAAATCAATTAGTACACCGCTATGTTTAATACTTATTCATATTTT
AGTTTTTAGGATTGAGAATCAATACAAAAAATTAATGCATCATTAATTTTAGAAATACTTAGTTTCCACGTAG
TCAATGAAACATTTGAACTCATCGTACAGGACGTTCTCGTACAGGACGTAACTATAAACCGGTTTATATTTGT
TCAAGATAGATACAAATCCGATAACTTTTTTTACGAATTCTACGGGATCCACTTTAAAAGTGTCATACCGGGT
TCTTTTTATTCTTTTAAACAGATCAATGGTGTGATGTTGATTAGGTCTTTTACGAATTTGATATAGAATAGCGT
TCACATATCCTCCATAATGGTCAATCGCCATTTGTTCGTATGTCATAAATTCTTTAATTATATGACACTGTGTAT
TATTTAGTTCATCCTTGTTCATCATTAGGAATCTATCCAAAATGGCAATTATACTAGAACTATAGGTGCGTTGT
ATACACATATTGATGTGTCTGTTTATACAATCCATGATATTTGGATCCATGCTACTACCTTCGGGTAAAATTGTA
GCATCATATACCATTTCTAGTACTTTAGGTTCATTATTATCCATTGCAGAGGACGTCATGATCGAATCATAAAA
AAATATATTATTTTTATGTTATTTTGTTAAAAATAATCATCGAATACTTCGTAAGATACTCCTTCATGAACATAAT
CAGTTACAAAACGTTTATATGAAGTAAAGTATCTACGATTTTTACAAAAGTCCGGATGCATAAGTACAAAGT
ACGCGATAAACGGAATAATAATAGATTTATCTAGTCTATCTTTTTCTATAGCTTTCATAGTTAGATACATGGTCT
CAGAAGTAGGATTATGTAACATCAGCTTCGATAAAATGACTGGGTTATTTAGTCTTACACATTCGCTCATACA
TGTATGACCGTTAACTACAGAGTCTACACTAAAATGATTGAACAATAGATAGTCTACCATTGTTTCGTATTCA
GATAGTACAGCGTAGTACATGGCATCTTCACAAATTATATCATTGTCTAATAGATATTTGACGCATCTTATGGA
TCCCACTTCAACAGCCATCTTAAAATCGGTAAAATCATATTGCTTTCCTTTATCATTAATAATTTCTAAAACATC
ATCTCTATCATAAAAGATACAAATATTAACTGTTTGATCCGTAATAACATTGCTAGTCGATAGCAATTTGTTAAT
AAGATGCGCTGGGCTCAATGTCTTAATAAGAAGTGTAAGAGGACTATCTCCGAATTTGTTTTGTTTATTAAC
ATCCGTTGATGGAAGTAAAAGATCTATAATGTCTACATTCTTGACTGTTTTAGAGCATACAATATGGAGAGGT
GTATTTCCATCATGATCTGGTTTTGAGGGACTAATTCCTAGTTTCATCATCCATGAGATTGTAGAAGCTTTTG
GATTGTCTGACATAAGATGTCTATGAATATGATTTTTGCCAAATTTATCCACTATCCTGGCTTCGAATCCGATG
GACATTATTTTTTTAAACACTCTTTCTGAAGGATCTGTACACGCCAACAACGGACCACATCCTTCTTCATCAA
CCGAGTTGTTAATCTTGGCTCCATACTGTACCAATAAATTTATTCTCTCTATGACTTCATCATCTGTTCCCGAG
AGATAATATAGAGGTGTTTTATTATGTTTATCACACGCGTTTGGATCTGCGCCGTGCGTCAGCAGCATCGCG
ACTATTCTATTATTATTAATTTTAGAAGCTATATGCAATGGATAATTTCCATCATCATCCGTCTCATTTGGAGAG
TATCCTCTATGAAGAAGTTCTTCGACAAATCGTTCATCTAGTCCTTTAATTCCACAATACGCATGTAGAATGTG
ATAATTATTTCCAGAAGGTTCGATAGCTTGTAGCATATTCCTAAATACATCTAAATTTTTACTATTATATTTGGC
ATAAAGAGATAGATAATACTCGGCCGACATAATGTTGTCCATTGTAGTATAAAAATTAATATTTCTATTTCTATT
TCTGTATATTTGCAACAATTTACTCTCTATAACAAATATCATAACTTAGTTCTTTTATGTCAAGAAGGCACTGG
TTTAGTTCATCTATAAATGTCACGCCATAACTACCACGCATGCCATACTCAGAATTATGATAAAGATATTTATCC

<div align="center">FIG.15G</div>

TTGGGGTGTAGGTAATGGGGATTAATCTTTGTTGGATCAGTCTCTAAGTTAACACATGTCACACATGATCCA
TTTATAGTTATATCACACGATGATGATTTATGAATTGATTCCGGAAGATCGCTATCGTATTTTGTGGTTCCACA
ATTCATTTCCATACATGTTATTGTCACACTAATATTATGATGAACTTTATCTAGCCGCTGAGTGGTAAACAACA
GAACAGATAGTTTATTATCTTTACCAACACCCTCAGCCGCTGCCACAAATCTCTGATCCGTATCCATGATGGT
CATGTTTATTTCTAGTCCGTATCCAGTCAACACTATGTTAGCATTTCTGTCGATATAGCTTTCACTCATATGACA
CTCACCAATAATAGTAGAATTAATGTCGTAATTTACACCAATAGTGAGTTCGGCGGCAAAGTACCAATACCG
GTAATCTTGTCGAGGAGGACATATAGTATTCTTGTATTCTACTGAATACCCGAGAGATGCGATACAAAAGAG
TAAGACTAATTTGTAAACCATCTTACTCAAAATATGTAACAATAGTACGATGCAATGAGTAAGACAATAGGA
AATCTATCTTATATACACATAATTATTCTATCAATTTTACCAATTAGTTAGTGTAATGTTAACAAAAATGTGGGA
GAATCTAATTAGTTTTTCTTTACACAATTGACGTACATGAGTCTGAGTTCCTTGTTTTTGCTAATTATTTCATC
CAATTTATTATTCTTGACTATATCGAGATCTTTTGTATAGGAGTCAGACTTGTATTCAACATGCTTTTCTATAAT
CATTTTAGCTATTTCGGCATCATCCAATAGTACATTTTCCAGATTAGCAGAATAGATATTAATGTCGTATTTGA
ACAGAGCCTGTAACATCTCAATGTCTTTATTATCTATAGCCAATTTAATGTCCGGAATGAAGAGAAGGGAAT
TATTGGTGTTTGTCGACGTCATATAGTCGAGCAAGAGAATCATCATATCCACGTGTCCATTTTTTATAGTGGT
GTGAATACAACTAAGGAGAATAGCCAGATCAAAAGTAGATGGTATCTCTGAAAGAAAGTAGGAAACAATA
CTTACATCATTAAGCATGACGGCATGATAAAATGAAGTTTTCCATCCAGTTTTCCCATAGAACATCAGTCTCC
AATTTTTCTTAACAAACAGTTTTACCGTTTGCATGTTACCACTATCAACCGCATAATACAATGCGGTGTTTCC
CTTGTCATCAAATTGTGAATCATCCAGTCCACTGAATAGCAAAATCTTTACTATTTTGGTATCTTCCAATGTGG
CTGCCTGATGTAATGGAAATTCATTCTCTAGAAGATTTTTCAATGCTCCAGCGTTCAACAACGTACATACTAG
ACGCACGTTATTATCAGCTATTGCATAATACAAGGCACTATGTCCATGGACATCCGCCTTAAATGCATCTTTG
CTAGAGAGAAAGCTTTTCAGCTGCTTAGACTTCCAAGTATTAATTCGTGACAGATCCATGTCTGAAACGAG
ACGCTAATTAGTGTATATTTTTTCATTTTTTATAATTTTGTCATATTGCACCAGAATTAATAATATCTCTAATAGA
TCTGATTAGTAGATACATGGCTATCGCAAAACAACATATACACATTTAATAAAAATAATATTTATTAAGAAAAT
TCAGATTTCACGTACCCATCAATATAAATAAAATAATGATTCCTTACACCGTACCCATATTAAGGAGATTCCAC
CTTACCCATAAACAATATAAATCCAGTAATATCATGTCTGATGATGAACACAAATGGTGTATTAAATTCCAGTT
TTTCAGGAGATGATCTCGCCGTAGCTACCATGATAGTAGATGCCTCTGCTACAGTTCCTTGTTCGTCGACATC
TATCTTTGCATTCTGAAACATTTTATAAATATATAATGGGTCCCTAGTCATATGTTTAAACAACGCATTATCTGG
ATTAAACATACTAGGAGCCATCATTTCGGCTATCGACTTAATATCCCTCTTATTTTCGATAGAAAATTTAGGGA
GTTTAAGATTGTACACTTTATTCCCTAATTGAAACGACCAATAGTCTAATTTTGCAGCCGTAATAGAATCTGT
GAAATGGGTCATATTATCACCTATTGCCAGGTACATACTAATATTAGCATCCTTATACGGAAGGCGTACCATAT
CATATTCTTCGTCATCGATTGTGATTGTATTTCCTTGCAATTTAGTAACTACGTTCATCATGGGAACCGTTTTC
GTACCGTACTTATTAGTAAAACTAGCATTGCGTGTTTTAGTGATATCAAACGGATATTGCCATATACCTTTAAA
ATATATAGTATTAATGATTGCCCATAGAGTATTATTGTCGAGCATATTAGAATCTACTACATTAGACATACCGGA
TCTACGTTCTACTATAGAATTAATTTTATTAACCGCATCTCGTCTAAAGTTTAATCTATATAGGCCGAATCTATG
ATATTGTTGATAATACGACGGTTTAATGCACACAGTATTATCTACGAAACTTTGATAAGTTAGATCAGTGTAC
GTATATTTAGATGTTTTCAGCTTAGCTAATCCTGATATTAATTCTGTAAATGCTGGACCCAGATCTCTTTTTCTC
AAATCCATAGTCTTCAATAATTCTATTCTAGTATTACCTGATGCAGGCAATAGCGACATAAACATAGAAACG
AATAACCAAACGGTGAGAAGACAATATTATCATCTTGAATATTTTTATACGCTACTATACCGGCATTGGTAAAT
CCTTGCAGACGATAGGTAGACACTGAACACGTTAACGATAGTATCAATAACGCAATCATGATTTTATGGTATT
AATAATTAACCTTATTTTTATGTTCGGTATAAAAATTATTGATGTCTACACATCCTTTTGTAATTGACATCTATAT
ATCCTTTTGTATAATCAACTCTAATCACTTTAACTTTTACAGTTTTCCCTACCAGTTTATCCCTATATTCAACATA
TCTATCCATATGCATCTTAACACTCTCTGCCAAGATAGCTTCAAAGTGAGGATAGTCAAAAAGATAAATATAT
AGAGCATAATCATTCTCGTATACTCTGCCCTTTATTACATCACCCGCATTGGGCAACGAATAACAAAATGCAA
GCATCTTGTTAACGGGCTCGTAAATTGGGATAAAATTATGTTTTTATATCTATTTTATTCAAGAGAATATTCAG

FIG.15H

GAATTTCTTTTTCCGGTTGTATCTCATCGCAGTATATATCATTTGTACATTGTTTCATATTTTTTAATAGTCTACA
CCTTTTAGTAGGACTAGTATCGTACAATTCATAGCTGTATTTTGAATTCCAATCACGCATAAAAATATCTTCCA
ATTGTTGACGAAGACCTAATCCATCATCCGGTGTAATATTAATAGATGCTCCACATGTATCCGTAAAGTAATTT
CCTGTCCAATTTGAGGTACCTATATACGCCGTTTTATCGGTTACCATATATTTGGCATGGTTTACCCTAGAATA
CGGAATGGGAGGATCAGCATCTGGTACAATAAATAGCTTTACTTCTATATTTATGTTTTTAGATTTTAGCATA
GCGATAGATCTTAAAAAGTTTCTCATGATAAACGAAGATCGTTGCCAGCAACTAATCAATAGCTTAACGGAT
ACTTGTCTGTCTATAGCGGCTCTTCTTAATTCATCTTCTATATAAGGCCAAAACAAAATATTGCCTGCCTTCGA
ATAAATAATAGGGATAAAGTTCATAACAGATACATAAACGAATTTACTCGCATTTCTAATACATGACAATAAA
GCGGTTAAATCATTGGTTCTTTCCATAGTACATAGTTGTTGCGGTGCAGAAGCAATAAATACAGAGTGTGG
AACACCACTTACGTTAATACTAAGAGGATGATCTGTATTATAATACGACGGATAAAAGTTTTTCCAATTATATG
GTAGATTGTTAACTCCAAGATACCAGTATACCTCAAAAATTTGAGTGAGATCCGCTGCCAAGTTCCTATTATT
GAAGATCGCAATACCCAATTCTTTGACCTGAGTTAGTGATCTCCAATCCATGTTAGCGCTTCCTAAATAAATA
TGTGTATTATCAGATATCCAAAATTTTGTATGAAGAACTCCTCCTAGGATATTTGTAATATCTATGTATCGTACT
TCAACTCCGGCCATTTGTAGTCTTTCAACATCCTTTAATGGTTTGTTAGATTTATTGACGGCTACTCTAACTCT
TACTCCTCTTTTGGGTAATTGTACAATCTCGTTTAATATTATCGTGCCGAAATTCGTACCCACTTCATCCGATA
AACTCCAATAAAAAGATGATATATCTAGTGTTTTTGTGGTATTGGATAGAATTTCCCTCCACATGTTAAATGTA
GACAAATATACTTTATCAAATTGCATACCTATAGGAATAGTCTCTGTAATCACTGCGATTGTATTATCCGGATT
CATTTTATTTGTTAAAAAATAATCCTATATCACTTCACTCTATTAAAAATCCAAGTTTCTATTTCTTTCATGACT
GATTTTTTAACTTCATCCGTTTCCTTATGAAGATGATGTTTGGCACCTTCATAAATTTTTATTTCTCTATTACAA
TTTGCATGTTGCATGAAATAATATGCACCTAAAACATCGCTAATCTCATTGTTTGTTCCCTGGAGTATGAGAG
TCGGGGGTGTTAATCTTGGGAATTATTTTTCTAACCTTGTTGGTAGCCTTCAAGACCTGACTAGCAAATCCA
GCCTTAATTTTTTCATGATTGATTAATGGGTCGTATTGGTATTTATAAACTTTATCCATATCTCTAGATACTGAT
TCTGGACATAGCTTTCCGACTGGCGCATTTGGTGTGATGGTTCCCATAAGTTTGGCAGCTAGCAGATTCAG
TTTTGAAACAGCATCTGCATTAACTAGAGGAGACATTAGAATCATTGCTGTAAACAAGTTTGGATTATCGTA
AGAGGCTAGTATAGAAATTGTTGCTCCCATGGAATGCCCAATAAGAAGACTGGAACTCCTAAATAAGTAGA
TTTAATAGTTACCACGTGCTGTACCACATCTCTAACATACGTACCAAAGTCATCAATCATCATTTTTTCACCAT
TACTTCTTCCATGTCCAATATGATCATGTGAGAATACTAAAATTCCTAACGATGATATGTTTTCAGCTAGTTCG
TCATAACGTCCAGAATGTTTACCAGCTCCATGACTTATGAATACTAATGCCTTAGGATATGTAATAGGTTTCCA
ATATATGTAATCATTGTCCAGATTGAACATACAGTTTGCACTCATGATTCACGTTATATAACTATCAATATTAAC
AGTTCGTTTGATGATCATATTATTTTTATGTTTTATTGATAATTGTAAAAACATACAATTAAATCAATATAGAGG
AAGGAGACGGCTACTGTCTTTTGTGAGATAGTCATGGCGACTAAATTAGATTATGAGGATGCTGTTTTTTAC
TTTGTGGATGATGATAAAATATGTAGTCGCGACTCCATCATCGATCTAATAGATGAATATATTACGTGGAGAA
ATCATGTTATAGTGTTTAACAAAGATATTACCAGTTGTGGAAGACTGTACAAGGAATTGATGAAGTTCGATG
ATGTCGCTATACGGTACTATGGTATTGATAAAATTAATGAGATTGTCGAAGCTATGAGCGAAGGAGACCACT
ACATCAATTTTACAAAAGTCCATGATCAGGAAAGTCTATTCGCTACCATAGGAATATGTGCTAAAATCACTGA
ACATTGGGGATACAAAAAGATTTCAGAATCTAGATTCCAATCATTGGGAAACATTACAGATCGATGACCGA
CGATAATATAAACATCTTGATACTTTTTCTAGAAAAAAAATTGAATTGATGATATAGGGGTCTTCATAACGCA
TAATTATTACGTTAGCATTCTATATCCGTGTTAAAAAAAATTATCCTATCATGTATTTGAGAGTTTTATATGTAG
CAAACATGATAGCTGTGATGCCAATAAGCTTTAGATATTCACGCGTGCTAGTGTTAGGGATGGTATTATCTG
GTGGTGAAATGTCCGTTATATAATCTACAAACAATCATCGCATATAGTATGCGATAGTAGAGTAAACATTTTT
ATAGTTTTTACTGGATTCATACATCGTCTACCCAATTTGGTTATAAATGAAATTGTCGCCAATCTTACACCCAA
CCCCTTGTTATCCATTAGTATAGTATTAACTTCGTTATTTATGTCATAAACTGTAAATGATTTTGTAGATGCCAT
ATCATACATGATATTCATGTCCCTATTATAATCATTACTAACTTTATCACAATATATGTTGATAATATCTATATATGA
TCTAGTCTTTGTGGGCAACTGTCTATACAAGTCGTCTAAACGTTGTTTACTCATATAGTATCGAACAGCCATC

*FIG.151*

ATTACATGGTCCCGTTCCGTTGATAGATAATCGAGTATGTTAGTGGACTTGTCAAATCTATATACCATATTTTC
TGGAAGTGGATATACATAGTCGTGATCAACATTATTGCTAGCCTCATCTTCTATATCATGTACTATACCATTATC
TATATCATCTACATAATCTACGATATTATTACACATAAACATCGACAACATACTATTGTTTATTATCTAAGTCCTG
TTGATCCAAACCCTTGATCTCCTCTATTTGTACTATCTAGAGATTGTACTTCTTCCAGTTCTGGATAATATATAC
GTTGATAGATTAGCTGAGCTATTCTATCTCCAGTATTTACATTAAACGTACATTTTCCATTATTAATAAGAATGA
CTCCTATGTTTCCCCTATAATCTTCGTCTATTACACCACCTCCTATATCAATGCCTTTTAGTGACAGACCAGACC
TAGGAGCTATTCTACCATAGCAAATCTTAGGCATGGACATACTAATATCTGTCTTAATTAACTGTCTTTCTCCT
GGAGGATAGTATAATCGTAAGCGCTATACAAATCATATCCGGCAGCACCCGGCGATTGCCTAGTAGGAGATT
TAGCTCTGTTAGTTTCCTTAACAAATCTAACTGGTGAGTTAATATTCATGTTGAACATAAAACTAATATTTTAT
TTCAAAATTATTTACCATCCCATATATTCCATGAATAAGTGTGATGATTGTACACTTCTATAGTATCTATATACGA
TTCACGATAAAATCCTCCTATCAATAGCAGTTTATTATCCACTATGATCAATTCTGGATTATCCCTCGGATAAAT
AGGATCATCTATCAGAGTCCATGTATTGCTGGATTCACAATAAAATTCCGCATTTCTACCAACCAAGAATAAC
CTTCTACCGAACACTAACGCGCATGATTTATAATGAGGATAATAAGTGGATGGTCCAAACTGCCACTGATCA
TGATTGGGTAGCAAATATTCTGTAGTTGTATCAGTTTCAGAATGTCCTCCCATTACGTATATAACATTGTTTAT
AGATGCCACTGCTGGATTACATCTAGGTTTCAGAAGACTCGGCATATTAACCCAAGCAGCATCCCCGTGGA
ACCAACGCTCAACAGATGTGGGATTTGGTAGACCTCCTACTACGTATAATTTATTGTTAGCGGGTATCCCGC
TAGCATACAGTCTGGGGCTATTCATCGGAGGAATTGGAATCCAATTGTTTGATATATAATTTACAGCTATAGC
ATTGTTATGTATTTCATTGTTCATCCATCCACCGATGAGATATACTACTTCTCCAACATGAGTACTTGTACACAT
ATGGAATATATCTATAATTTGATCCATGTTCATAGGATACTCTATGAATGGATACTTGTATGATTTGCGTGGTTG
TTTATCACAATGAAATATTTTGGTACAGTCTAGTATCCATTTTACATTATTTATACCTCTGGGAGAAAGATAAT
TTGACCTGATTACATTTTTGATAAGGAGTAGCAGATTTCCTAATTTATTTCTTCGCTTTATATACCACTTAATG
ACAAAATCAACTACATAATCCTCATCTGGAACATTTAGTTCATCGCTTTCTAGAATAAGTTTCATAGATAGATA
ATCAAAATTGTCTATGATGTCATCTTCCAGTTCCAAAAAGTGTTTGGCAATAAAGTTTTTAGTATGACATAAG
AGATTGGATAGTCCGTATTCTATACCCATCATGTAACACTCGACACAATATTCCTTTCTAAAATCTCGTAAGAT
AAAGTTTATACAAGTGTAGATGATAAATTCTACAGAGGTTAATATAGAAGCACGTAATAAATTGACGACGTT
ATGACTATCTATATATACCTTTCCAGTATACGAGTAAATAACTATAGAAGTTAAACTGTGAATGTCAAGGTCTA
GACAAACCCTCGTAACTGGATCTTTATTTTTCGTGTATTTTTGACGTAAATGTGTGCGAAAGTAAGGAGATA
ACTTTTTCAATATCGTAGAATTGACTATTATATTGCCACCTATAGCATCAATAATTGTTTTGAATTTCTTAGTCA
TAGACAATGCTAATATATTCTTACAGTACACAGTATTAACAAATATCGGCATTTATGTTTCTTTAAAAGTCAAC
ATCTAGAGAAAATGATTATCTTTTTGAGACATAACTCCCATTTTTTGGTATTCACCCACACGTTTTTCGAAA
AAATTAGTTTTTCCTTCCAATGATATATTTTCCATGAAATCAAACGGATTGGTAACATTATAAATTTTTTTAAAT
CCCAATTCAGAAATCAATCTATCCGCGACGAATTCTATATATGTTTTCATCATTTCACAATTCATTCCTATAAGT
TTAACTGGAAGAGCCGCAGTAAGAAATTCTTGTTCAATGGATACTGCATCTGTTATAATAGATCTAACGGTT
TCTTCACTCGGTGGATACAATAAATGTTTAAACATCAAACATGCGAAGTCGCAGTGTAGACCCTCGTCTCTA
CTAATTAGTTCGTTGGAAAACGTGAGTCCGGGCATTAGGCCACGCTTTTTAAGCCAAAATATGGAAGCGAA
TGATCCGGAAAAGAAGATTCCTTCTACTGCAGCAAAGGCAATAAGTCTCTCTCCATAACCGGCGCTGTCAT
GTATCCACTTTTGAGCCCAATCGGCCTTCTTTTTTACACAAGGCATCGTTTCTATGGCATTAAAGAGATAGTT
TTTTTCATTACTATCTTTAACATAAGTATCGATCAAAAGACTATACATTTCCGAATGAATGTTTTCAATGGCCA
TCTGAAATCCGTAGAAACATCTAGCCTCGGTAATCTGTACTTCTGTACAAAATCGTTCCGCCAAATTTTCATT
CACTATTCCGTCACTGGCTGCAAAAAACGCCAATACATGTTTTATAAAATATTTTTCGTCTGGTGTTAGTTTAT
TCCAATCATTGATATCTTTAGATATATCTACTTCTTCCACTGTCCAAAATGATGCCTCTGCCTTTTTATACATGTT
CCAGATGTCATAATATTGGATTGGGAAAATAACAAATCTATTTGGATTTGGTGCAAGGATGGGTTCCATAAC
TAAATTAACAATATCAATAAATTTTTTTTTCAGTTATCTATATGCCTGTACTTGGATTTTTTGTACATCGATATCG
CCGCAATCACTACAATAATTACAAGTATTATTGATAGCATTGTTATTAGTACTATCATAATTAAATTATCGACAT

FIG.15J

TCATGGGTGCTGAATAATCGTTATTATCATCATTATCATTTTGTAATTGTGACATCATACTAAATAAATCGTTTG
CGAGATTGTTGTGGGAAGCGGGCATGGAGGATGCATTATCATTATTATTTAACGCCTTCCATTTGGATTCAC
AAATGTTACGCACATTCAACATTTTATGGAAACTATAATTTTGTGAAAACAGATAACAAGAAAACTCGTTATC
GTTCAAATTTTTAACGATAGTAAACCGATTAAACGTCGAGCTAATTTCTAACGCTAGCGACTCTGTTGGATAT
GGGTTTCCAGATATATATCTTTTCAGTTCCCCTACGTATCTATAATCATCTGTAGGAAATGGAAGATATTTCCA
TTTATCTACTGTTCCTAATATCATATGTGGTGGTGTAGTAGAACCATTAAGCGCGAAAGATGTTATTTCGCATC
GTATTTTAACTTCGCAATAATTTCTGGTTAGATAACGCACTCTACCAGTCAAGTCAATGATATTAGCCTTTACA
GATATATTCATAGTAGTCGTAACGATGACTCCATCTTTTAGATGCGATACTCCTTTGTATGTACCAGAATCTTC
GTACCTCAAACTCGATATATTTAAACAAGTTAATGAGATATTAACGCGTTTTATGAATGATGATATATAACCAG
AAGTTTTATCCTCGGTGGCTAGCGCTATAACCTTATCATTATAATACCAACTAGTGTGATTAATATGTGACACG
TTAGTGTGGGTACAAATATGTACATTATCGTCTACGTCGTATTCGATACATCCGCATACAGCCAACAAATATAA
AATGACAAATACTCTAACGCCGTTCGTACCCATCTTGATGCGGTTTAATAAATGTTTTGATTTCAATTTATTGT
AAAAAAAGATTCGGTTTTATACTGTTCGATATTCTCATTGCTTATATTTTCATCTATCATCTCCACACAGTCAA
ATCCGTGGTTAGCATGCACCTCATCAACCGGTAAAAGACTATCGGACTCTTCTATCATTATAACTCTAGAATAT
TTAATTTGGTCATTATTAATCAAGTCAATTATCTTATTTTTAACAAACGTGAGTATTTTACTCATTTTTTATAAA
AACTTTTAGAAATATACAGACTCTATCGTGTGTCTATATCTTCTTTTTATATCCAATGTATTTATGTCTGATTTTT
CTTCATTTATCATATATAATGGTCCAAATTCTACACGTGCTTCGGATTCATCCAGATCATTAAGGTTCTTATAAT
TGTAACATCCTTCTCTTCCCTCTTCTACATCTTCCTTCTTATTCTTATTCTTAGCGTCACAGAATCTACCACAGC
AGGATCCCATGACGAGCGTCATATTAAACTAATTCATTTTCAATTATAATATACTGGTAATGACCATTAAAATA
AAAATATTCTTCATAACCGGTAAGAAAGTGAAAAGTTCACATTGAAACTATGTCAGTAGTATACATCATGAA
ATGAGATGAAATGATGATATATATACTCTATTTTGGTGGAGGATTATATGATATAATTCGTGGATAATCATTTTT
AAGACACATTTCTTTATTCGTAAATCTTTTCACGTTAAATGAGTGTCCATATTTTGCAATTTCTTCATATGATG
GCGGTGTACGTGGACGAGGCTGCTCCTGTTCTTGTTGTAGTCGCCGACTGTCGTGTTTGCGTTTAGATCCC
TCCATTATCGCGATTGCGTAGATGGAGTACTATTATATACCTTGTAATTAAATTTTTTTATTAATTAAACGTATA
AAAACGTTCCGTATCTGTATTTAAGAGCCAGATTTCGTCTAATAGAACAAATAGCTACAGTAAAAATAACTA
GAATAATTGCTACACCCACTAGAAACCACGGATCGTAATACGGCAATCGGTTTTCGATAATAGGTGGAACGT
ATATTTTATTTAAGGACTTAACAATTGTCTGTAAACCACAATTTGCTTCCGCGGATCCTGTATTAACTATCTGT
AAAAGCATATGTTGACCGGGCGGAGCCGAACATTCTCCGATATCTAATTTCTGTATATCTATAATATTATTAAC
CTCCGCATACGCATTACAGTTCTTTTCTAGCTTGGATACCGCACTAGGTACATCGTCTAGATCTATTCCTATTT
CTTCAGCGATAGCTCTTCTATCCTTTTCCGGAAGCAATGAAATCACTTCAATAAATGATTCAACCATGAGTGT
GAAACTAAGTCGAGAATTACTCATGCATTTGTTAGTTATTCGGAGCGCGCAATTTTTAAACTGTCCTATAACC
TCTCCTATATGAATAGCACAAGTGACATTAGTAGGGATAGAATGTTGAGCTAATTTTTGTAAATAACTATCTAT
AAAAAGATTATACAAAGTTTTAAACTCTTTAGTTTCCGCCATTTATCCAGTCTGAGAAAATGTCTCTCATAAT
AAATTTTTCCAAGAAACTAATTGGGTGAAGAATGGAAACCTTTAATCTATATTTATCACAGTCTGTCTTGGTA
CACATGATGAATTCTTCTAATGCTGTACTAAATTCGATATCTTTTTCGATTTCTGGATATGTTTTTAATAAAGTA
TGAACAAAGAAATGGAAATCGTAATACCAGTTATGTTTAACTTTGAAATTGTTTTTTATTTTCTTGTTAATGA
TTCCAGCCACTTGGGAAAAGTCAAAGTCGTTTAATGCCGATTTAATACGTTCATTAAAAACAAACTTTTTAT
CCTTTAGATGAATTATTATTGGTTCATTGGAATCAAAAAGTAAGATATTATCGGGTTTAAGATCTGCGTGTAA
AAAGTTGTCGCAGCATGGTAGTTCGTAAATTTTAATGTATAACAGAGCCATCTGTAAAAAGATAAACTTTAT
GTATTGTACCAAAGATTTAAATCCTAATTTGATAGCTAACTCGGTATCTACTTTATCTGCAGAATACAGTGCTA
GGGGAAAAATTATAATATTTCCTCTTTCGTATTCGTAGTTAGTTCTCTTTTCATGTTCGAAAAAGTGAAACAT
GCGGTTAAAATAGTTTATAACATTAATATTACTGTTAATAACTGCCGGGTAAAAGTGGGATAGTAATTTCACG
AATTTGATACTGTCCTTTCTCTCGTTAAACGCCTTTAAAAAAACTTTAGAAGAATATCTCAATGAGAGTTCCT
GACCATCCATAGTTTGTATCAATAATAGCAACATATGAAGAACCCGTTTATACAGAGTATGTAAAAATGTTAA

<div align="center">*FIG.15K*</div>

TTTATAGTTTAATCCCATGGCCCACGCACACACGATTAATTTTTTTTCATCTCCCTTTAGATTGTTGTATAGAA
ATTTGGGTACTGTGAACTCCGCCGTAGTTTCCATGGGACTATATAATTTTGTGGCCTCGAATACAAATTTTAC
TACATAGTTATCTATCTTAAAGACTATACCATATCCTCCTGTAGATATGTGATAAAAATCGTCGTTTATAGGATA
AAATCGTTTATCCTTTTGTTGGAAAAAGGATGAATTAATGTAATCATTCTCTTCTATCTTTAGTAGTGTTTCCC
TATTAAAATTCTTAAAATAATTTAACAATCTAACTGACGGAGCCCAATTTTGGTGTAAATCTAATTGGGACAT
TATATTGTTAAAATACAAACAGTCTCCTAATATAACAGTATCTGATAATCTATGGGGAGACATCCATTGATATTC
AGGGGATGAATCATTGGCAACACCCATTTATTGTACAAAAAGCCCCAATTTACAAACGAAAGTCCAGGTTT
GATAGAGACAAACTATTAACTATTTTGTCTCTGTTTTTAATTTCTTTAGTAATGAAATTATTCACAATATCAGTA
TCTTCTTTATCTACCAGAGATTTTACTAACTTGATAACCTTGGCTGTCTCATTCAATAGGGTAGTAATATTTGT
ATGTGTGATATTGATATCTTTTTGAATTGTTTCTTTTAGAAGTGATTCTTTGATGGTGCCAGCATACGAATTAC
AATAATGCAGAAACTCGGTTAACATGCAGGAATTATAGTAAGCCAATTCCAATTGTTGCCTGTATTGTATTAG
AGTATTAATATGCGCAATGGTGTCCTTGCGTTTCTCTGATAGAATGCGAGCAGCGATTTTGGCGTTATCATTT
GACGATATTTCTGGAATGACGAATCCTGTTTCTACTAACTTTTTGGTAGGACAAAGTGAAACAATCAAGAA
GATAGCTTCTCCTCCTATTTGTGGAAGAAATTGAACTCCTCTAGATGATCTACTGACGATAGTATCTCCTTGA
CAGATATTGGACCGAATTACAGAAGTACCTGGAATGTAAAGCCCTGAAACCCCCTCATTTTTTAAGCAGATT
GTTGCCGTAAATCCTGCACTGTGACCAAGATAGAGAGCTCCTTTGGTGAATCCATCTCTATGTTTCAGTTTA
ACCAAGAAACAGTCAGCTGGTCTAAAATTTCCATCTCTATCTAATACAGCATCTAACTTGATGTCAGGAACTA
TGACCGGTTTAATGTTATATGTAACATTGAGTAAATCCTTAAGTTCATAATCATCACTGTCATCAGTTATGTAC
GATCCAAACAATGTTTCTACCGGCATAGTGGATACGAAGATGCTATCCATCAGAATGTTTCCCTGATTAGTAT
TTTCTATATAGCTATTCTTCTTTAAACGATTTTCCAAATCAGTAACTATGTTCATTTTTTTAGGAGTAGGACGC
CTAGCCAGTATGGAAGAGGATTTTCTAGATCCTCTCTTCAACATCTTTGATCTCAATGGAATGCAAAACCCC
ATAGTGAAACAACCAACGATAAAAATAATATTGTTTTTCACTTTTTATAATTTTACCATCTGACTCATGGATTC
ATTAATATCTTTATAAGAGCTACTAACGTATAATTCTTTATAACTGAACTGAGATATATACACCGGATCTATGGT
TTCCATAATTGAGTAAATGAATGCTCGGCAATAACTAATGGCAAATGTATAGAACAACGAAATTATACTAGA
GTTGTTAAAGTTAATATTTTCTATGAGCTGTTCCAATAAATTATTTGTTGTGACTGCGTTCAAGTCATAAATCA
TCTTGATACTATCCAGTAAACAGTCTTTAAGTTCTGGAATATTATCATCCCATTGTAAAGCCCCTAATTCGACT
ATCGAATATCCTGCTCTGATAGCAGTTTCAATATCGACGGACGTCAATACTGTAATAAAGGTGGTAGTATTGT
CATCATCGTGATAAACTACTGGAATATGGTCGTTAGTAGGTACGGTAACTTTACACAACGCGATATATAACTT
TCCTTTTGTACCATTTTTAACGTAGTTGGGACGTCCTGCAGGGTATTGTTTTGAAGAAATGATATCGAGAAC
AGATTTGATACGATATTTGTTGGATTCCTGATTATTTACTATAATATAATCTAGACAGATAGATGATTCGATAAA
TAGAAAAGGTATATCGTTGGTAGGATAATACATCCCCATTCCAGTATTCTCGGATACTCTATTAATGACACTAG
TTAAGAACATGTCTTCTATTCTAGAAAACGAAAACATCCTACATGGACTCATTAAAACTTCTAACGCTCCTGA
TTGTGTCTCGAATGCCTCGTACAAGGATTTCAAGGATGCCATAGATTCTTTGACCAACGATTTAGAATTGCG
TTTAGCATCTGATTTTTTTATTAAATCGAATGGTCGGCTCTCTGGTTTGCTACCCCAATGATAACAATAGTCTT
GTAAAGATAAACCGCAAGAAAATTTATACGCATCCATCCAAATAACCCTAGCACCATCGGATGATATTAATGT
ATTATTATAGATTTTCCATCCACAGTTATTGGGCCAGTATACTGTTAGCAACGGTATATCGAATAGATTACTCA
TGTAACCTACTAGAATGATAGTTCGTGTACTAGTCATAATATCTTTAATCCAATCTAAGAAATATAAAATTAGAT
CTTTTACACTGTTAAAGTTAACAAAGGTATTACCCGGATACGTGGATATCATATATGGCATTGGTCCATTATCA
GTAATAGCTCCATAAACTGATACGGCGATGGTTTTTATATGTGTTTGATCTAACGAGGAAGAAATTCGCGCC
CACAATTCATCTCTAGATATGTATTTAATATCAAACGGTAACACATCAATTTCGGGACGCGTATATGTTTCTAA
ATTTTTAATCCAAATATAATGATGACCTATATGCCCTATTATCATACTGTCAACTATAGTACACCTAGAGAACTT
ACGATACATCTGTTTCCTGTAATCGTTAAATTTTACAAATCTATAACATGCTAAACCTTTTGACGACAACCATT
CATTAATTTCTGATATGGAATCTGTATTCTCGATACCGTATTGTTCTAAAGCCAGTGCTATATCTCCCTGTTCGT
GGGAACGCTTTCGTATAATATCGATCAACGGATAATCTGAAGTTTTTGGAGAATAATATGACTCATGATCTAT

FIG.15L

TTCGTCCATAAACAATCTAGACATAGGAATTGGAGGCGATGATCTTAATTTTGTGCAATGAGTCGTCAATCC
TATAACTTCTAATCTTGTAATATTCATCATCGACATAATACTATCTATGTTATCATCGTATATTAGTATACCATGAC
CTTCTTCATTTCGTGCCAAAATGATATACAGTCTTAAATAGTTACGCAATATCTCAATAGTTTCATAATTGTTAG
CTGTTTTCATCAAGATTTGTACCCTGTTTAACATGATGGCGTTCTATACGTTTCTATTTTCTATTTTTTAAATTT
TTAACGATTTACTGTGGCTAGATACCCAATCTCTCTCAAATATTTTTTTAGCCTCGCTTACAAGCTGTTTATCT
ATACTATTAAAACTGACGAATCCGTGATTTTGGTAATGGGTTCCGTCGAAATTTGCCGAAGTGATATGAACA
TATTCGTCGTCGACTATCAACAATTTTGTATTATTCTGAATAGTGAAAACCTTCACAGATAGATCATTTTGAAC
ACACAACGCGTCTAGACTTCTGGCGGTTGCCATAGAATATACGTCGTTCTTATCCCAATTACCAACTAGAAG
TCTGATCTTAACTCCTCTATTAATGGCTGCTTCTATAATGGAGTTGTAAATGTCGGGCCAATAGTAGCTATTAC
CGTCGACACGTGTAGTGGGAACTATGGCCAAATGTTCAATATCTATACTAGTCTTAGCTGACCTGAGTTTATC
AATAACTACATCGGTATCTAGATCTCTAGAATATCCCAATAGGTGTTCCGGAGAATCAGTAAAGAACACTCCA
CCTATAGGATTCTTAATATGATACGCAGTGCTAACTGGCAGACAACAAGCCGCAGAGCATAAATTCAACCAT
GAATTTTTTGCGCTATTAAAGGCTTTAAAAGTATCAAATCTTCTACGAAGATCTGTGGCCAGCGGGGGATA
ATCAGAATATACACCTAACGTTTTAATCGTATGTATAGATCCTCCAGTAAATGACGCGTTTCCTACATAACATC
TTTCATCATCTGACACCCAAAAACAACCGAGTAGTAGTCCCACATTATTTTTTTATCTATATTAACGGTTATAA
AATTTATATCCGGGCAGTGACTTTGTAGCTCTCCCAGATTTCTTTTCCCTCGTTCATCTAGCAAAACTATTATT
TTAATCCCTTTTTCAGATGCCTCTTTTAGTTTATCAAAAATAAGCGCTCCCCTAGTCGTACTCAGAGGATTAC
AACAAAAAGATGCTATGTATATATATTTCTTAGCTAGAGTGATAATTTCGTTAAAACATTCAAATGTTGTTAAA
TGATCGGATCTAAAATCCATATTTTCTGGTAGTGTTTCTACCAGCCTACATTTTGCTCCCGCAGGTACCGATG
CAAATGGCCACATTTAGTTAACATAAAAACTTATACATCCTGTTCTATCAACGATTCTAGAATATCATCGGCTA
TATCGCTAAAATTTTCATCAAAGTCGACATCACAACCTAACTCAGTCAATATATTAAGAAGTTCCATGATGTC
ATCTTCGTTTATTTCTATATCCGTATCCATTGTAGATTGTTGACCGATTATCGAGTTTAAATCATTACTAATACTC
AATCCTTCAGAATACAATCTGTGTTTCATTGTAAATTTATAGGCGGTGTATTTAAGTTGGTAGATTTTCAATTA
TGTATCAATATAGCAACAGTAGTTCTTGCTCCTCCTTGATTCTAGCATCCTCTTCATTATTTTCTTCTACGTACA
TAAACATGTCCAATACGTTAGACAACACACCGACGATGGCGGCCGCCACAGACACGAATATGACTAAACCG
ATGACCATTTAAAAACCCCTCTCTAGCTTTCACTTAAACTGTATCGATTATTCTTTTAGAACATGTATAATATAA
AAACATTATTCTATTTCGAATTTAGGCTTCCAAAAATTTTTCATCCGTAAACCGATAATAATATATATAGACTTG
TTAATAGTCGGAATAAATAGATTAATGCTTAAACTATCATCATCTCCACGATTAGAGATACAATATTTACATTCT
TTTTGCTGTTTCGAAACTTTATCAATACACGTTAATACAAACCCAGGAAGGAGATATTGAAACTGAGGCTGT
TGAAAATGAAACGGTGAATACAATAATTCAGATAATGTAAAATCATGATTCCGTATTCTGATGATATTAGAAC
TGCTAATGGATGTCGATGGTATGTATCTAGGAGTATCTATTTTAACAAAGCATCGATTTGCTAATATACAATTA
TCCTTTTGATTAATTGTTATTTTATTCATATTCTTAAAAGGTTTCATATTTATCAATTCTTCTACATTAAAAATTT
CCATTTTTAATTTATGTAGCCCCGCAATACTCCTCATTACGTTTCATTTTTTGTCTATAATATCCATTTTGTTCAT
CTCGGTACATAGATTATCCAATTGAGAAGCGCATTTAGTAGTTTTGTACATTTTAAGTTTATTGACAAATCGT
CGAAAACTAGTTATAGTTAACATTTTATTATTTGATACCCTGATATTAATACCCCTGCCGTTACTATTATTTATAA
CTGATGTAATCCACGTAACATTAGAATTAATTATCGATAGTAATGCATCGACGCTTCCAAAATTGTCTATTATA
AACTCACCGATAATTTTTTTATTGCATGTTTTCATATTCATTAGGATTATCAAATCTTTAATCTTATTACGATTGT
ATGCGTTGATATTGCAAGACGTCATTCTAAAAGACGGAGGATCTCCATCAAATGCCAAACAATCACGTACAA
AGTACATGGAAATAGGTTTTGTTCTATTGCGCATCATAGATTTATATAGAACACCCGTAGAAATACTAATTTGT
TTTACTCTATAAAATACTAATGCATCTATTTCATCGTTTTGTATAACGTCTTTCCAAGTGTCAAATTCCAAATTT
TTTTCATTGATAGTACCAAATTCTTCTATCTCTTTAACTACTTGCATAGATAGGTAATTACAGTGATGCCTACAT
GCCGTTTTTTGAAACTGAATAGATGCGTCTAGAAGCGATGCTACGCTAGTCACAATCACCACTTTCATATTTA
GAATATATGTATGTAAAAATATAGTAGAATTTCATTTTGTTTTTTTTCTATGCTATAAATGAATTCTCATTTTGCAT
CTGCTCATACTCCGTTTTATATCAATACCAAAGAAGGAAGATATTTGGTTCTAAAAGCCGTTAAAGTATGCGA

<div style="text-align:center"><em>FIG.15M</em></div>

TGTTAGAACTGTAGAATGTGAAGGAAGTAAAGCTTCCTGCGTACTCAAAGTAGATAAACCCTCATCACCCG
CGTGTGAGAGAAGACCTTCGTCCCCTTCCAGATGCGAGAGAATGAATAACCCAGGAAAACAAGTTCCGTT
TATGAGGACGGACATGCTACAAAATATGTTCGCGGCTAATCGCGATAATGTAGCTTCTAGACTTTTGTCCTA
AAATACTATTATATCCTTTTCGATATTAATAAATCCGTGTCGTCCAGGTTTTTTATCTCTTTCAGTATGTGAATA
GATAGGTATTTTATCTCTATTCATCATCGAATTTAAGAGATCCGATAAACATTGTTTGTATTCTCCAGATGTCA
GCATCTGATACAACAATATATGTGCACATAAACCTCTGGCACTTATTTCATGTACCTTCCCCTTATCACTAAGG
AGAATAGTATTTGAGAAATATGTATACATGATATTATCATGAATTAGATATACAGAATTTGTAACACTCTCGAA
ATCACACGATGTGTCGGCGTTAAGATCTAATATATCACTCGATAACACATTTTCATCTAGATACACTAGACATT
TTTTAAAGCTAAAATAGTCTTTAGTAGTGACAGTAACTATGCGATTATTTTCATCGATGATACATTTCATCGGC
ATATTATTACGCTTACCATCAAAGACTATACCATGTGTATATCTAACGTATTCTAGCATGGTTGCCATACGCGC
ATTAAACTTTTCAGGATCTTTGGATAGATCTTCCAATCTATCTATTTGAGAAAACATTTTTATCATGTTCAATA
GTTGAAACGTCGGATCCACTATATAGATATTATCTATAAAGATTTTAGGAACTACGTTCATGGTATCCTGGCG
AATATTAAAACTATCAATGATATGATTATCGTTTTCATCTTTTATCACCATATAGTTTCTAAGATATGGGATTTTA
CTTAATATAAATATTATTTCCCGTGATAAATTTTATTAGAAAGGCCAAATCTATAAGAAAAGTCCTAGAATTAGT
CTGAAGAATATCTATATCGCCGTATAGTATATTTGGATTAATTAGATATAGAGAATATGATCCGTAACATATACA
ACTTTTATTATGGCGTCTAAGATATTCTTCCATCAACTTATTAACATTTTTGACTAGGGAAGATACATTATGAC
GTCCCATTACTTTTGCCTTGTCTATTACTGCGACGTTCATAGAATTTAGCATATCTCTTGCCAATTCTTCCATTG
ATGTTACATTATAAGAAATTTTAGATGAAATTACATTTGGAGCTTTAATAGTAAGAACTCCTAATATGTCCGTG
TATGTGGTCACTAATACAGATTGTAGTTCTATAATCGTAAATAATTTACCTATATTATATGTTTGAGTCTGTTTA
GAAAAGTAGCTAAGTATACGATCTTTTATTTCTGATGCAGATGTATTAACATCGGAAAAAAATCTTTTTTTAT
TCTTTTTTACTAAAGATACAAATATGTCTTTGTTAAAAACAGTTATTTTTTGAATATTTCTAGCTTGTAATTTTA
ACATATGATATTCGTTCACACTAGGTACTCTGCCTAAATAGGTTTCTATAATCTTTAATGTAATATTAGGAAAA
GTATTCTGATCAGGATTCCTATTCATTTTGAGGATTTAAAACTCTGATTATTGTCTAATATGGTCTCTACGCAA
ACTTTTTCACAGAGCGATAGAGTTTTTGATAACTCGTTTTTCTTAAGAAATATAAAACTACTGTCTCCAGAGC
TCGCTCTATCTTTTATTTTATCTAATTCGATACAAACTCCTGATACTGGTTCAGAAAGTAATTCATTAATTTTCA
GTCCTTTATAGAAGATATTTAATATAGATAATACAAAATCTTCAGTTTTTGATATCGATCTGATTGATCCTAGAA
CTAGATATATTAATAACGTGCTCATTAGGCAGTTTATGGCAGCTTGATAATTAGATATAGTATATTCCAGTTCAT
ATTTATTAGATACCGCATTGCCCAGATTTTGATATTCTATGAATTCCTCTGAAAATAAATCCAAAATAACTAGA
CATTCTATTTTTTGTGGATTAGTGTACTCTCTTCCCTCTATCATGTTCACTACTGGTGTCCACGATGATAAATAT
CTAGAGGGAATATAATATAGTCCATAGGATGCCAATCTAGCAATGTCGAATAACTGTAATTTTATTCTTCGCTC
TTCATTATGAATTGATTCTTGAGGTATAAACCTAACACAAATTATATTATTAGACTTTTCGTATGTAATGTCTTT
CATGTTATAAGTTTTTAATCCTGGAATAGAATCTATTTTAATGAGGCTTTTAAACGCAGAGTTCTCCAACGAG
TCAAAGCATAATACTCTGTTGTTTTTCTTATATACGATGTTACGATTTTCTTCTTTGAATGGAATAGGTTTTTG
AATTAGTTTATAATTACAACATAATAGATAAGGAAGTGTGCAAATAGTACGCGGAAAAAACATAATAGCTCC
CCTGTTTTCATCCATGGTTTTAAGTAAATGATCACTGGCTTCTTTAGTCAATGGATATTCGAACATTAACCGTT
TCATCATCATTGGACAGAATCCATATTTTTTAATGTAAAGAGTGATCAAATCATTGTGTTTATTGTACCATCTT
GTTGTAAATGTGTATTCGGTTATCGGATCTGCTCCTTTTTCTATTAAAGTATCGATGTCGATCTCGTCTAAGAA
TTCAACTATATCGACATATTTCATTTGTATACACATAACCATTACTAACGTAGAATGTATAGGAAGAGATGTAA
CGGGAACAGGGTTTGTTGATTCGCAAACTATTCTAATACATAATTCTTCTGTTAATACGTCTTGCACGTAATC
TATTATAGATGCCAAGATATCTATATAATTATTTTGTAAGATGATGTTAACTATGTGATCTATATAAGTAGTGTAA
TAATTCATGTATTTTGATATATGTTCCAACTCTGTCTTTGTGATGTCTAGTTTCGTAATATCTATAGCATCCTCAA
AAAATATATTCGCATATATTCCCAAGTCTTCAGTTCTATCTTCTAAAAAATCTTCAACGTATGGAATATAATAAT
CTATTTTACCTCTTCTGATATCATTAATGATATAGTTTTTGACACTATCTTCTGTCAATTGATTCTTATTCACTAT
ATCTAAGAAACGGATAGCGTCCCTAGGACGAACTACTGCCATTAATATCTCTATTATAGCTTCTGGACATAAT

*FIG.15N*

TCATCTATTATACCAGAATTAATGGGAACTATTCCGTATCTATCTAACATAGTTTTAAGAAAGTCAGAATCTAA
GACTTGATGTTCATATATTGGTTCATACATGAAATGATCTCTATTGATGATAGTGACTATTTCATTCTCTGAAA
ATTGGTAACTCATTCTATATATGCTTTCCTTGTTGATGAAGGATAGAATATACTCAATAGAATTTGTACCAACA
AACTGTTCTCTTATGAATCGTATATCATCATCTGAAATAATCATGTAAGGCATACATTTAACAATTAGAGACTT
GTCTCCTGTTATCAATATACTATTCTTGTGATAATTTATGTGTGAGGCAAATTTGTCCACGTTCTTTAATTTTGT
TATAGTAGATATCAAATCCAATGGAGCTACAGTTCTTGGCTTAAACAGATATAGTTTTTCTGGAACGAATTCT
ACAACATTATTATAAAGGACTTTGGGTAGATAAGTGGGATGAAATCCTATTTAATTAATGCGATAGCCTTGT
CCTCGTGCAGATATCCAAACGCTTTTGTGATAGTATGGCATTCATTGTCTAGAAACGCTCTACGAATATCTGT
GACAGATATCATCTTTAGAGAATATACTAGTCGCGTTAATAGTACTACAATTTGTATTTTTTAATCTATCTCAAT
AAAAAAATTAATATGTATGATTCAATGTATAACTAAACTACTAACTGTTATTGATAACTAGAATCAGAATCTAA
TGATGACGTAACCAAGAAGTTTATCTACTGCCAATTTAGCTGCATTATTTTTAGCATCTCGTTTAGATTTTCCA
TCTGCCTTATCGAATACTCTTCCGTCGATATCTACACAGGCATAAAATGTAGGAGAGTTACTAGGCCCCACTG
ATTCAATACGAAAAGACCAATCTCTCTTAGTTATTTGGCAGTACTCATTAATAATGGTGACAGGGTTAGCATC
TTTCCAATCAATAATTTTTTTAGCCGGAATAACATCATCAAAAGACTTATGATCCTCTCTCATTGATTTTTCGC
GGGATACATCATCTATTATGGCGTCAGCCATAACATCAGCATCCGGCTTATCCGCCTCCGTTGTCATAAACCA
ACGAGGAGGAATATCGTCGGAGCTGTACACCATAGCACTACGTTGAAGATCGTACAGAGCTTTATTAACTT
CTCGCTTCTCCATATTAAGTTGTCTAGTTAGTTGTGCAGCAGTAGCTCCTTCGATTCCAATGTTTTTAATAGCC
GCACACACAATCTCTGCGTCAGAACGCTCGTCAATATAGATCTTAGACATTTTTAGAGAGAACTAACACAAC
CAGCAATAAAACTAATTTATTTTATCATTTTTTTATTCATCATCCTCTGGTGGTTCGTCGTTTCTATCGAATGTG
GATCTGATTAACCCGTCATCTATAGGTGATGCTGGTTCTGGAGATTCTGGAGGAGATGGATTATTATCTGGA
AGAATCTCTGTTATTTCCTTGTTTTCATGTATCGATTGCGTTGTAACATTAAGATTGCGAAATGCTCTAAATTT
GGGAGGCTTAAAGTGTTGTTTGCAATCTCTACACGCATGTCTAACTAGTGGAGGTTCGTCAGCGGCTCTAG
TTTGAATCATCATCGGCGTAGTATTCCTACTTTTACAGTTAGGACACGGTGTATTGTATTTCTCGTCGAGAAC
GTTAAAATAATCGTTGTAACTCACATCCTTTATTTTATCTATATTGTATTCTACTCCTTTCTTAATGCATTTTATAC
CGAATAAGAGATAGCGAAGGAATTCTTTTTCGGTGCCGCTAGTACCCTTAATCATATCACATAGTGTTTTATA
TTCCAAATTTGTGGCAATAGACGGTTTATTTCTATCGATAGTTTGTTTCTGGAATCCTTTGAGTATTCTATAC
CAATATTATTCTTTGATTCGAATTTAGTTTCTTCGATATTAGATTTTGTATTACCTATATTCTTGATGTAGTACTT
TGATGATTTTTCCATGGCCCATTCTATTAAGTCTTCCAAGTTGGCATCATCCACATATTGTGATAGTAATTCTC
GGATATCAGTAGCGGCTACCGCCATTGATGTTTGTTCATTGGATGAGTAACTACTAATGTATACATTTTCCATT
TATAACACTTATGTATTAACTTTGTTCATTTATATTTTTCATTATTATGTTGATATTAACAAAAGTGAATATATATA
TATGTTAATAATTGTATTGTGGTTATACGGCTACAATTTTATAATGAGTGAAAGTCAGTGTCCGATGATCAATG
ACGATAGCTTTACTCTGAAAAGAAAGTATCAAATCGATAGTGCGGAGTCAACAATAAAAATGGATAAGAAG
AGGATAAAGTTTCAGAATAGAGCCAAAATGGTAAAAGAAATAAATCAGACAATAAGAGCAGCACAAACTC
ATTACGAGACATTGAAACTAGGATACATAAAATTTAAGAGAATGATTAGGACTACTACTCTAGAAGATATAG
CACCATCTATTCCAAATAATCAGAAAACTTATAAACTATTCTCGGACATTTCAGCCATCGGCAAAGCATCACA
GAATCCGAGTAAGATGGTATATGCTCTGCTGCTTTACATGTTTCCCAATTTGTTTGGAGATGATCATAGATTC
ATTCGTTATAGAATGCATCCAATGAGTAAAATCAAACACAAGATCTTCTCTCCTTTCAAACTTAATCTTATTAG
AATATTAGTGGAAGAAAGATTCTATAATAATGAATGCAGATCTAATAAATGGAAATAATTGGAACACAAGT
TGATAAAATGTTGATAGCTGAATCTGATAAATATACAATAGATGCAAGGTATAACCTAAAACCCATGTATAGA
ATCAAGGGAGAATCTGAAGAAGATACCCTCTTTATCAAACAGATGGTAGAACAATGTGTGACATCCCAGGA
ATTGGTGGAAAAGTGTTGAAGATACTGTTTAGAGATTTGTTCAAGAGTGGAGAATACAAAGCGTACAGA
TACGATGATGATGTAGAAAATGGATTTATTGGATTGGATACACTAAAATTAAACATTGTTCATGATATAGTTG
AACCATGTATGCCTGTTCGTAGGCCAGTGGCTAAGATACTGTGTAAAGAAATGGTAAATAAATACTTTGAGA
ATCCGCTACATATTATTGGTAAAAATCTTCAAGAGTGCATTGACTTTGTTAGTGAATAGGCATTTCATCTTTCT

*FIG.150*

CCAATACTAATTCAAATTGTTAAATTAATAATGGATAGTATAAATAGTTATTAGTGATAAAATAGTAAAAATAAT
TATTAGAATAAGAGTGTAGTATCATAGATAACTCTCTTCTATAAAAATGGATTTTATTCGTAGAAAGTATCTTAT
ATACACAGTAGAAAATAATATAGATTTTTTAAAGGATGATACATTAAGTAAAGTAAACAATTTTACCCTCAAT
CATGTACTAGCTCTCAAGTATCTAGTTAGCAATTTTCCTCAACACGTTATTACTAAGGATGTATTAGCTAATAC
CAATTTTTTTGTTTTCATACATATGGTACGATGTTGTAAAGTGTACGAAGCGGTTTTACGACACGCATTTGAT
GCACCCACGTTGTACGTTAAAGCATTGACTAAGAATTATTTATCGTTTAGTAACGCAATACAATCGTACAAG
GAAACCGTGCATAAACTAACACAAGATGAAAAATTTTTAGAGGTTGCCGAATACATGGACGAATTAGGAG
AACTTATAGGCGTAAATTATGACTTAGTTCTTAATCCATTATTTCACGGAGGGGAACCCATCAAAGATATGGA
AATCATTTTTTTAAAACTGTTTAAGAAAACAGACTTCAAAGTTGTTAAAAAATTAAGTGTTATAAGATTACTT
ATTTGGGCATACCTAAGCAAGAAAGATACAGGCATAGAGTTTGCGGATAATGATAGACAAGATATATATACT
CTATTTCAACAAACTGGTAGAATCGTCCATAGCAATCTAACAGAAACGTTTAGAGATTATATCTTTCCCGGA
GATAAGACTAGCTATTGGGTGTGGTTAAACGAAAGTATAGCTAATGATGCGGATATCGTTCTTAATAGACAC
GCCATTACCATGTATGATAAAATTCTTAGTTATATATACTCTGAGATAAAACAGGGACGCGTTAATAAAAACA
TGCTTAAGTTAGTTTATATCTTTGAGCCTGAAAAAGATATCAGAGAACTTCTGCTAGAAATCATATATGATATT
CCTGGAGATATCCTATCTATTATTGATGCAAAAAACGACGATTGGAAAAAATATTTTATTAGTTTTTATAAAGC
TAATTTTATTAACGGTAATACATTTATTAGTGATAGAACGTTTAACGAGGACTTATTCAGAGTTGTTGTTCAA
ATAGATCCCGAATATTTCGATAATGAACGAATTATGTCTTTATTCTCTACGAGTGCTGCGGACATTAAACGAT
TTGATGAGTTAGATATTAATAACAGTTATATATCTAATATAATTTATGAGGTGAACGATATCACATTAGATACAA
TGGATGATATGAAGAAGTGTCAAATCTTTAACGAGGATACGTCGTATTATGTTAAGGAATACAATACATACCT
GTTTTTGCACGAGTCGGATCCCATGGTCATAGAGAACGGAATACTAAAGAAACTGTCATCTATAAAATCCAA
GAGTAGACGGCTGAACTTGTTTAGCAAAAACATTTTAAAATATTATTTAGACGGACAATTGGCTCGTCTAG
GTCTTGTGTTAGATGATTATAAAGGAGACTTGTTAGTTAAAATGATAAACCATCTTAAGTCTGTGGAGGATG
TATCCGCATTCGTTCGATTTTCTACAGATAAAAACCCTAGTATTCTTCCATCGCTAATCAAAACTATTTTAGCT
AGTTATAATATTTCCATCATCGTCTTATTTCAAAGGTTTTTAAGAGATAATCTATATCATGTAGAAGAATTCTTG
GATAAAAGCATCCATCTAACCAAGACGGATAAGAAATATATACTTCAATTGATAAGACACGGTAGATCATAG
AACAGACCAAATATATTATTAATAATTTGTATATACATAGATATAATTATCACATATTAAAAATTCACACATTTTT
GATAAATGGGAACTGCTGCAACAATTCAGACTCCCACCAAATTAATGAATAAAGAAAATGCAGAAATGATT
TTGGAAAAAATTGTTGATCATATAGTTATGTATATTAGTGACGAATCAAGTGATTCAGAAAATAATCCTGAAT
ATATTGATTTTCGTAACAGATACGAAGACTATAGATCTCTCATTATAAAAAGTGATCACGAGTTTGTAAAGCT
ATGTAAAAATCATGCAGAGAAAAGTTCTCCAGAAACGCAACAAATGATTATCAAACACATATACGAACAATA
TCTTATTCCAGTATCTGAAGTACTATTAAAACCTATAATGTCCATGGGTGACATAATTACATATAACGGATGTA
AAGACAATGAATGGATGCTAGAACAACTCTCTACCCTAAACTTTAACAATCTCCGCACATGGAACTCATGTA
GCATAGGCAATGTAACGCGTCTGTTTTATACATTTTTTAGTTATCTGATGAAAGATAAACTAAATATATAAGTA
TAATCCCATTCTAATACTTTAACCTGATGTATTAGCATCTTATTAGAATATTAACCTAACTAAAAGACATAACAT
AAAAACTCATTACATAGTTGATAAAAAGCGGTAGGATATAAATATTATGGCTGCCACCGTTCCGCGTTTTGA
CGACGTGTACAAAAATGCACAAAGAAGAATTCTAGATCAAGAAACATTTTTTAGTAGAGGTCTAAGTAGAC
CGTTAATGAAAAACACATATCTATTTGATAATTACGCGTATGGATGGATACCAGAAACTGCAATTTGGAGTA
GTAGATACGCAAACTTAGATGCAAGTGACTATTATCCCATTTCGTTGGGATTACTTAAAAAGTTCGAGTTTCT
CATGTCTCTATATAAAGGTCCTATTCCAGTATACGAAGAAAAGTAAATACTGAATTCATTGCTAATGGATCG
TTCTCTGGTAGATACGTATCATATCTTCGAAAGTTTTCTGCTCTTCCAACAAACGAGTTTATTAGTTTTTTGTT
ACTGACTTCCATTCCAATCTATAATATCTTGTTCTGGTTTAAAAATACTCAGTTTGATATTACTAAACACACATT
ATTCAGATACGTCTATACAGATAATGCCAAACACCTGGCGTTGGCTAGGTATATGCATCAAACAGGAGACTA
TAAGCCTTTGTTTAGTCGTCTCAAAGAGAATTATATATTTACCGGTCCCGTTCCAATAGGTATCAAAGATATA
AATCACCCTAATCTTAGTAGAGCAAGAAGTCCATCCGATTATGAGACATTAGCTAATATTAGTACTATATTGTA

*FIG.15P*

CTTTACCAAGTATGATCCGGTATTAATGTTTTTATTGTTTTACGTACCTGGGTATTCAATTACTACAAAAATTA
CTCCAGCCGTAGAATATCTAATGGATAAACTGAATCTAACAAAGAGCGACGTACAACTGTTGTAAATTATTTT
ATGCTTCGTAAAATGTAGGTTTTGAACCAAACATTCTTTCAAAGAATGAGATGCATAAAACTTTATTATCCAA
TAGATTGACTATTTCGGACGTCAATCGTTTAAAGTAAACTTCGTAAAATATTCTTTGATCACTGCCGAGTTTA
AAACTTCTATCGATAATTGTTTCATATGTTTTAATATTTACAAGTTTTTTGGTCCATGGTACATTAGCCGGACA
AATATATGCAAAATAATATCGTTCTCCAAGTTCTATAGTTTCTGGATTATTTTTATTATATTCAGTAACCAAATAC
ATATTAGGGTTATCTGCGGATTTATAATTTGAGTGATGCATTCGACTCAACATAAATAATTCTAGAGGAGACG
ATCTACTATCAAATTCGGATCGTAAATCTGTTTCTAAAGAACGGAGAATATCTATACATACCTGATTAGAATTC
ATCCGTCCTTCAGACAACATCTCAGACAGTCTGGTCTTGTATGTCTTAATCATATTCTTATGAAACTTGGAAA
CATCTCTTCTAGTTTCACTAGTACCTTTATTAATTCTCTCAGGTACAGATTTTGAATTCGACGATGCCGAGTAT
TTCATCGTTGTATATTTCTTCTTCGATTGCATAATCAGATTCTTATATACCGCCTCAAACTCTATTTTAAAATTAT
TAAACAATACTCTATTATTAATCAGTCGTTCTAACTCCTTTGCTATTTCTATGGACTTATCTACATCTTGACTGT
CTATCTCTGTAAACACGGAGTCGGTATCTCCATACACGCTACGAAAACGAAATCTGTAATCTATAGGCAACG
ATGTTTTCACAATCGGATTAATATCTCTATCGTCCATATAAAATGGATTACTTAATGGATTGGCAAACCGTAAC
ATACCGTTAGATAACTCTGCTCCATTTAGTACCGATTCTAGATACAAGATCATTCTACGTCCTATGGATGTGCA
ACTCTTAGCCGAAGCGTATGAGTATAGAGCACTATTTCTAAATCCCATCAGACCATATACTGAGTTGGCTACT
ATCTTGTACGTATATTGCATGGAATCATAGATGGCCTTTTCAGTTGAACTGGTAGCCTGTTTTAACATCTTTTT
ATATCTGGCTCTCTCTGCCAAAAATGTTCTTAATAGTCTAGGAATGGTTCCTTCTATCGATCTATCGAAAATTG
CTATTTCAGAGATGAGGTTCGGTAGTCTAGGTTCACAATGAACCGTAATATATCTAGGAGGTGGATATTTCT
GAAGCAAGAGCTGATTATTTATTTCTTCTTCCAATCTATTGGTACTAACAACGACACCGACTAATGTTTCCGG
AGATAGATTTCCAAAGATACACACATTAGGATACAGACTGTTATAATCAAAGATTAATACATTATTACTAAAC
ATTTTTTGTTTTGGAGCAAATACCTTACCGCCTTCATAAGGAAACTTTTGTTTTGTTTCTGATCTAACTAAGA
TAGTTTTAGTTTCCAACAATAGCTTTAACAGTGGACCCTTGATGACTGTACTCGCTCTATATTCGAATACCAT
GGATTGAGGAAGCACATATGTTGACGCACCCGCGTCTGTTTTTGTTTCTACTCCATAATACTCCCACAAATAC
TGACACAAACAAGCATCATGAATACAGTATCTAGCCATATCTAAAGCTATGTTTAGATTATAATCCTTATACAT
CTGAGCTAAATCAACGTCATCCTTTCCGAAAGATAATTTATATGTATCATTAGGTAAAGTAGGACATAATAGT
ACGACTTTAAATCCATTTTCCCAAATATCTTTACGAATTACTTTACATATAATATCCTCATCAACAGTCACATAA
TTACCTGTGGTTAAAACCTTTGCAAATGCAGCGGCTTTGCCTTTCGCGTCCGTAGTATCGTCACCGATGAAC
GTCATTTCTCTAACTCCTCTATTTAATACTTTACCCATGCAACTGAACGCGTTCTTGGATATAGAATCCAATTT
GTACGAATCCAATTTTTCAGATTTTTGAATGAATGAATATAGATCGAAAAATATAGTTCCATTATTGTTATTAA
CGTGAAACGTAGTATTGGCCATGCCGCCTACTCCCTTATGACTAGACTGATTTCTCTCATAAATACAGAGATG
TACAGCTTCCTTTTTGTCCGGAGATCTAAAGATAATCTTCTCTCCTGTTAATAACTCTAGACGATTAGTAATAT
ATCTCAGATCAAAGTTATGTCCGTTAAAGGTAACGACATAGTCGAACGTTAGTTCCAACAATTGTTTAGCTAT
TCGTAACAAAACTATTTCAGAACATAAAACTAGTTCTCGTTCGTAATCCATTTCCATTAGTGACTGTATCCTCA
AACATCCTCTATCGACGGCTTCTTGTATTTCCTGTTCCGTTAACATCTCTTCATTAATGAGCGTAAACAATAAT
CGTTTACCACTTAAATCGATATAACAGTAACTTGTATGCGAGATTGGGTTAATAAATACAGAAGGAAACTTC
TTATCGAAGTGACACTCTATATCTAGAAATAAGTACGATCTTGGGATATCGAATCTAGGTATTTTTTAGCGAA
ACAGTTACGTGGATCGTCACAATGATAACATCCATTGTTAATCTTTGTCAAATATTGCTCGTCCAACGAGTAA
CATCCGTCTGGAGATATCCCGTTAGAAATATAAAACCAACTAATATTGAGAAATTCATCCATGGTGGCATTTT
GTATGCTGCGTTTCTTTGGCTCTTCTATCAACCACATATCTGCGACGGAGCATTTTCTATCTTTAATATCTAGA
TTATAACTTATTGTCTCGTCAATGTCTATAGTTCTCATCTTTCCCAACGGCCTCGCATTAAATGGAGGAGGAG
ACAATGACTGATATATTTCGTCCGTCACTACGTAATAAAAGTAATGAGGAAATCGTATAAATACGGTCTCACC
ATTTCGACATCTGGATTTCAGATATAAAAATCTGTTTTCACCGTGACTTTCAAACCAATTAATGCACCGAACA
TCCATTTATAGAATTTAGAAATATATTTTCATTTAAATGAATCCCAAACATTGGGGAAGAGCCGTATGGACCA

*FIG.15Q*

TTATTTTTATAGTACTTTCGCAAGCGGGTTTAGACGGCAACATAGAAGCGTGTAAACGAAAACTATATACTAT
AGTTAGCACTCTTCCATGTCCTGCATGTAGACGGCACGCGACTATCGCTATAGAGGACAATAATGTCATGTC
TAGCGATGATCTGAATTATATTTATTATTTTTTCATCAGATTATTTAACAATTTGGCATCTGATCCCAAATACGC
GATCGATGTGACAAAGGTTAACCCTTTATAAACTTAACCCATTATAAAACTTATGATTAGTCACGACTGAAAT
AACCGCGTGATTATTTTTTGGTATAATTCTACACGGCATGGTTTCTGTGACTATGAATTCAACCCCCGTTACA
TTAGTGAAATCTTTAACAAACAGCAAGGGTTCGTCAAAGACATAAAACTCATTGTTTACAATCGAAATAGA
CCCCCTATCACACTTAAAATAAAAAATATCCTTATCCTTTACCACCAAATAAAATTCTGATTGGTCAATGTGAA
TGTATTCACTTAACAGTTCCACAAATTTATTTATTAACTCCGAGGCACATACATCGTCGGTATTTTTTATGGCA
AACTTTACTCTTCCAGCATCCGTTTCTAAAAAATATTAACGAGTTCCATTTATATCATCCAATATTATTGAAATG
ACGTTGATGGACAAATGATACAAATAAGAAGGTACGGTACCTTTGTCCACCATCTCCTCCAATTCATGCTCT
ATTTTGTCATTAACTTTAATGTATGAAAACAGTACGCCACATGCTTCCATGACAGTGTGTAACACTTTGGATA
CAAAATGTTTGACATTAGTATAATTGTTCAAGACTGTCAATCTATAATAGATAGTAGCTATAATATATTCTATGA
TGGTATTGAAGAAGATGACAACCTTGGCATATTGATCATTTAACACAGACATGGTATCAACAGATAGCTTGA
ATGAAAGAGAATCAGTAATTGGAATAAGCGTCTTCTCGATGGAGTGTCCGTATACCAACATGTCTGATATTT
TGATGTATTCCATTAAATTATTTAGTTTTTTCTTTTATTCTCGTTAAACAGCATTTCTGTCAACGGACCCCAAC
ATCGTTGACCGATTAAGTTTTGATTGATTTTTCCGTGTAAGGCGTATCTAGTCAGATCGTATAGCCTATCCAAT
AATCCATCGTCTGTGCGTAGATCACATCGTACACTTTTTAATTCTCTATAGAAGAGCGACAGACATCTGGAG
CAATTACAGACAGCAATTTCTTTATTCTCTACAGATGTAAGATACTTGAAGACATTCCTATGATGATGCAGAA
TTTTGGATAACACGGTATTGATGGTATCTGTTACCATAATTCCTTTGATGGCTGATAGTGTCAGAGCACAAGA
TTTCCAATCTTTGACAATTTTTAGCACCATTATCTTTGTTTTGATATCTATATCAGACAGCATGGTGCGTCTGA
CAACACAAGGATTAAGACGGAAAGATGAAATGATTCTCTCAACATCTTCAATGGATACCTTGCTATTTTTTC
TGGCATTATCTATATGTGCGAGAATATCCTCTAGAGAATCAGTATCCTTTTTGATGATAGTGGATCTCAATGAC
ATGGGACGTCTAAACCTTCTTATTCTATCACCAGATTGCATGGTGATTTGTCTTCTTTCTTTTATCATAATGTA
ATCTCTAAATTCATCGGCAAATTGTCTATATCTAAAATCATAATATGAGATGTTTACCTCTACAAATATCTGTTC
GTCCAATGTTAGAGTATTTACATCAGTTTTGTATTCCAAATTAAACATGGCAACGGATTTAATTTTATATTCCT
CTATTAAGTCCTCGTCGATAATAACAGAATGTAGATAATCATTTAATCCATCGTACATGGTTGGAAGATGCTC
GTTGACAAAATCTTTAATTGTCTTGATGAAGGTGGGACTATATCTAACATCTTGATTAATAAAATTTATAACAT
TGTCCATAGGATACTTTGTAACTAGTTTTATACACATCTCTTCATCGGTAAGTTTAGACAGAATATCGTGAAC
AGGTGGTATATTATATTCATCAGATATACGAAGAACAATGTCCAAATCTATATTGTTTAATATATTATATAGATGT
AGTGTAGCTCCTACAGGAATATCTTTAACTAAGTCAATGATTTCATCAACCGTTAGATCTATTTTAAAGTTAAT
CATATAGGCATTGATTTTTAAAAGGTATGTAGCCTTGACTACATTCTCATTAATTAACCATTCCAAGTCACTGT
GTGTAAGAAGATTATATTCTATCATAAGCTTGACTACATTTGGTCCCGATACCATTAAAGAATTCTTATGATAT
AAGGAAACAGATTTTAGGTACTCATCTACTCTACAAGAATTTTGGAGAGCCTTAACGATATCAGTGACGTTT
ATTATTTCAGGAGGAAAAAACCTAACATTGAGAATATCGGAATTAATAGCTTCCAGATACAGTGATTTTGGC
AATAGTCCGTGTAATCCATAATCCAGTAACACGAGCTGGTGCTTGCTAGACACCTTTTCAATGTTTAATTTTT
TGAAATAAGCTTTGATAAAGCCTTCCTCGCAAATTCCGGATACATGAACATGTCGGCGACATGATTAAGTAT
TGTTTTTTCATTATTTTTATATTTTCTCAACAAGTTCTCAATACCCCAATAGATGATAGAATATCACCCAATGCG
TCCATGTTGTCTATTTCCAACAGGTCGCTATATCCACCAATAGAAGTTTTCCCAAAAAAGATTCTAGGAACA
GTTCTACCACCAGTAATTTGTTCAAAATAGTCACGCAATTCATTTTCGGGTTTAAATTCTTTAATATCGACAAT
TTCATACGCTCCTCTTTTGAAACTAAACTTATTTAGAATATCCAGTGCATTTCTACAAAAAGGACATGTATACT
TGACAAAAATTGTCACTTTGTTATTGGCCAACCTTTGTTGTACAAATTCCTCGGCCATTTTAATATTTAAGTG
ATATAAAACTATCTCGACTTATTTAACTCTTTAGTCGAGATATATGGACGCAGATAGCTATATGATAGCCAACT
ACAGAAGGCAAACGCTATAAAAAACATAATTACGACGAGCATATTTATAAATATTTTTATTCAGCATTACTTG
ATATAGTAATATTAGGCACAGTCAAACATTCAACCACTCTCGATACATTAACTCTCTCATTTTCTTTAACAAAT

<div style="text-align:center">*FIG.15R*</div>

```
TCTGCAATATCTTCGTAAAAAGATTCTTGAAACTTTTTAGAATATCTATCGACTCTAGATGAAATAGCGTTCG
TCAACATACTATGTTTTGTATACATAAAGGCGCCCATTTTAACAGTTTCTAGTGACAAAATGCTAGCGATCCT
AGGATCCTTTAGAATCACATAGATTGACGATTCGTCTCTCTTAGTAACTCTAGTAAAATAATCATACAATCTAG
TACGCGAAATAATATTATCCTTGACTTGAGGAGATCTAAACAATCTAGTTTTGAGAACATCGATAAGTTCATC
GGGAATGACATACATACTATCTTTAATAGAACTCTTTTCATCCAGTTGAATGGATTCGTCCTTAACCAACTGA
TTAATGAGATCTTCTATTTTATCATTTTCCAGATGATATGTATGTCCATTAAAGTTAAATTGTGTAGCGCTTCTT
TTTAGTCTAGCAGCCAATACTTTAACATCACTAATATCGATATACAAAGGAGATGATTTATCTATGGTATTAAG
AATTCGTTTTTCGACATCTGTCAAAACCAATTCCTTTTGCCTGTATCATCCAGTTTTCCATCCTTTGTAAAGAA
ATTATTTTCTACTAGACTATTAATAAGACTGATAAGGATTCCTCCATAATTGCACAATCCAAACTTTTTCACAA
AACTAGACTTTACAAGATCTACAGGAATGCGTACTTCAGGTTTCTTAGCTTGTGATTTTTTCTTTTGTGGAC
ATTTTCTTGTGACCAACTCATCTACCATTTCATTGATTTTAGCAGTGAAATAAGCTTTCAATGCACGGGCACT
GATACTATTGAAAACGAGTTGATCTTCAAATTCCGCCATTTAAGTTCACCAAACAACTTTTAAATACAAATAT
ATCAATAGTAGTAGAATAAGAACTATAAAAAAAATAATAATTAACCAATACCAACCCCAACAACCGGTATTAT
TAGTTGATGTGACTGTTTTCTCATCACTTAGAACAGATTTAACAATTTCTATAAAGTCTGTCAAATCATCTTCC
GGAGACCCCATAAATACACCAAATATAGCGGCGTACAACTTATCCATTTATACATTGAATATTGGCTTTTCTTT
ATCGCTATCTTCATCATATTCATCATCAATATCAACAAGTCCCAGATTACGAGCCAGATCTTCTTCTACATTTTC
AGTCATTGATACACGTTCACTATCTCCAGAGAGTCCGATAACGTTAGCCACCACTTCTCTATCAATGATTAGT
TTCTTGAGTGCGAATGTAATTTTTGTTTCCGTTCCGGATCTATAGAAAACTACAGGTGTGATAATTGCCTTGG
CCAATTGTCTTTCTCTTTTACTGAGTGATTCTAGTTCACCTTCTATAGATCTGAGAATGGATGATTCTCCAGTC
GAAACATATTCTACCATGGCTCCGTTTAATTTGTTGATGAAGATGGATTCATCCTTAAATGTTTTCTCTGTAAT
AGTTTCCACCGAAAGACTATGCAAAGAATTTGGAATGCGTTCCTTGTGCTTAATGTTTCCATAGACGGCTTC
TAGAAGTTGATACAACATAGGACTAGCCGCGGTAACTTTTATTTTTAGAAAGTATCCATCGCTTCTATCTTGT
TTAGATTTATTTTTATAAAGTTTAGTCTCTCCTTCCAACATAATAAAAGTGGAAGTCATTTGACTAGATAAACT
ATCAGTAAGTTTTATAGAGATAGACGAACAATTAGCGTATTGAGAAGCATTTAGTGTAACGTATTCGATACAT
TTTGCATTAGATTTACTAATCGATTTTGCATACTCTATAACACCCGCACAAGTCTGTAGAGAATCGCTAGATG
CAGTAGGTCTTGGTGAAGTTTCAACTCTCTTCTTGATTACCTTACTCATGATTAAACCTAAATAATTGTACTTT
GTAATATAATGATATATATTTTCACTTTATCTCATTTGAGAATAAAAATGTTTTTGTTTAACCACTGCATGATGT
ACAGATTTCGGAATCACAAACCACCGGTGGTTTTATTTTATCCTTGTCCAATGTGAATTGAATGGGAGCGG
ATGCGGGTTTCGTACGTAGATAGTACATTCCCGTTTTTAGACCGAGACTCCATCCGTAAAAATGCATACTCG
TTAGTTTGGAATAACTCGGATCTGCTATATGGATATTCATAGATTGACTTTGATCGATGAAGGCTCCCCTGTC
TGCAGCCATTTTTATGATCGTCTTTTGTGGAATTTCCCAAATAGTTTTATAAACTCGCTTAATATCTTCTGGAA
GGTTTGTATTCTGAATGGATCCACCATCTGCCATAATCCTATTCTTGATCTCATCATTCCATAATTTTCTCTCGG
TTAAAACTCTAAGGAGATGCGGATTAACTACTTGAAATTCTCCAGACAATACTCTCCGAGTGTAAATATTACT
GGTATACGGTTCCACCGACTCATTATTTCCCAAAATTTGAGCAGTTGATGCAGTCGGCATAGGTGCCACCAA
TAAACTATTTCTAAGACCGTATGTTCTGATTTTATCTTTTAGAGGTTCCCAATTCCAAAGATCCGACGGTACA
ACATTCCAAAGATCATATTGTAGAATACCGTTACTGGCGTACGATCCTACATATGTATCGTATGGTCCTTCCTT
CTCAGCTAGTTCACAACTCGCCTCTAATGCACCGTAATAAATGGTTTCGAAGATCTTCTTATTTAGATCTTGT
GCTTCCAGGCTATCAAATGGATAATTTAAGAGAATAAACGCGTCCGCTAATCCTTGAACACCAATACCGATA
GGTCTATGTCTCTTATTAGAGATTTCAGCTTCTGGAATAGGATAATAATTAATATCTATAATTTTATTGAGATTT
CTGACAATTACTTTGACCACATCCTTCAGTTTGAGAAAATCAAATCGCCCATCTATTACAAACATGTTCAAGG
CAACAGATGCCAGATTACAAACGGCTACCTCATTAGCATCCGCATATTGTATTATCTCAGTGCAAAGATTACT
ACACTTGATAGTTCCTAAATTTTGTTGATTACTCTTTTTGTTACACGCATCCTTATAAAGAATGAATGGAGTAC
CAGTTTCAATCTGAGATTCTATAATCGCTTTCCAGACGACTCGAGCCTTTATTATAGATTTGTATCTCCTTTCT
CTTTCGTATAGTGTATACAATCGTTCGAACTCGTCTCCCCAAACATTGTCCAATCCAGGACATTCATCCGGAC
```

<div align="center">

*FIG.15S*

</div>

ACATCAACGACCACTCTCCGTCATCCTTCACTCGTTTCATAAAGAGATCAGGAATCCAAAGAGCTATAAATA
GATCTCTGGTTCTATGTTCCTCGTTTCCTGTATTCTTTTTAAGATCGAGGAACGCCATAATATCAGAATGCCA
CGGTTCCAAGTATATGGCCATAACTCCAGGCCGTTTGTTTCCTCCCTGATCTATGTATCTAGCGGTGTTATTAT
AAACTCTCAACATTGGAATAATACCGTTTGATATACCATTGGTACCGGAGATATAGCTTCCACTGGCACGAAT
ATTACTAATTGATAGACCTATTCCCCTGCCATTTTAGAGATTAATGCGCATCGTTTTAACGTGTCATAGATACC
CTCTATGCTATCATCGATCATGTTAAGTAGAAAACAGCTAGACATTTGGTGACGACTAGTTCCCGCATTAAAT
AAGGTAGGAGAAGCGTGCGTAAACCATTTTTCAGAAAGTAGATTGTACGTCTCAATAGCTGAGTCTATATCC
CATTGATGAATTCCTACTGCGACACGCATTAACATGTGCTGAGGTCTTTCAACGATCTTGTTGTTTATTTTCA
ACAAGTAGGATTTTTCCAAAGTTTTAAAACCAAAATAGTTGTATGAAAAGTCTCGTTCGTAAATAATAACCG
AGTTGAGTTTATCCTTATATTTGTTAACTATATCCATGGTGATACTTGAAATAATCGGAGAATGTTTCCCATTT
TTAGGATTAACATAGTTGAATAAATCCTCCATCACTTCACTAAATAGTTTTTTTGTTTCCTTGTGTAGATTTGA
TACGGCTATTCTGGCGGCTAGAATGGCATAATCCGGATGTTGTGTAGTACAAGTGGCTGCTATTTCGGCTGC
CAGAGTGTCCAATTCTACCGTTGTTACTCCATTATATATTCCTTGAATAACCTTCATAGCTATTTAATAGGATC
TATATGATCCGTGTTTAAGCCATAACATAATTTTCTAATACGAGACGTGATTTTATCAAACATGACATTTTCCT
TGTATCCATTTCGTTTAATGACAAACATTTTTGTTGGTGTAATAAAAAATTATTTAACTTTTCATTAATAGGGA
TTTGACGTACGTAGCGTACAAAATGATTGTTCCTGGTATATAGATAAAGAGTCCTATATATTTGAAAATCGTTA
CGGCTCGATTAAACTTTAATGATTGCATAGTGAATATATCATTAGGATTTAACTCCTTGACTATCAGGGCGGC
ACCAGAAATTACCATCAAAAGCATTAATACAGTTATGCCTATCGCAGTTAGAACGGTTATAGCATCCACCATT
TATATCTAAAAATTAGATCAAAGAATATGTGACAAAGTCCTAGTTGTATATTGAGAATTGACAAAACAATGTT
TCTTACATATTTTTTTTTATTAGTAACCGACTTAATAGTAGGAACTGGAAAACTAGACTTGATTATTCTATAAG
TATAGATACCCTTCCAAATAATATTCTCTTTGATAAAAGTTCCAGAAAATGTAGAATTTTTTAAAAAGTTATCT
TTTGCTATTACCAAGATTGTGTTTAGACGCTTATTATTAATATGAGTGATGAAATCCACACCGCCTCTAGATAT
CGCCTTTATTTCCACATTAGATGGTAAATCCAATAGTGAAACTATCTTTTTAGGAATGTATGGACTCGCGTTT
AGAGGAGTGAACGTCTTGGGCGTCGGAAAGGATGATTCGTCAAACGAATAAACAATTTCACAAATGGATG
TTAATGTATTAGTAGGAAATTTTTTGACGCTAGTGGAATTGAAGATTCTAATGGATGATGTTCTACCTATTTC
ATCCGATAACATGTTAATTTCCGACACCAACGGTTTTAATATTTCGATGATATACGGTAGTCTCTCTTTCGGAC
TTATATAGCTTATTCCACAATACGAGTCATTATATACTCCAAAAAACAAAATAACTAGTATAAAATCTGTATCGA
ATGGGAAAAACGAAATTATCGACATAGGTATAGAATCCGGAACATTGAACGTATTAATACTTAATTCTTTTTC
TGTGGTAAGTACCGATAGGTTATTGACATTGTATGGTTTTAAATATTCTATAACTTGAGACTTGATAGATATTA
GTGATGAATTGAAAATTATTTTTATCACCACGTGTGTTTCAGGATCATCGTCGACGCCCGTCAACCAACCGA
ATGGAGTAAAATAAATATCATTAATATATGCTCTAAATATTAGTATTTTTATTAATCCTTTGATTATCATCTTCTC
GTACGCGAATGATTCCATGATCAAGAGTGATTTGAGAACATCCTCCGGAGTATTAATGGGCTTAGTAAACA
GTACATCGTTGCAATAATAAAAGTTATCCAAGTTAAAGGATATTATGCATTCGTTTAAAGATATCACCTCATCT
GACGGAGACAATTTTTTGGTAGGTTTTAGAGACTTTGAAGCTACTTGTTTAACAAAGTTATTCATCGTCGTT
TACTATTCTATTTAATTTTGTAGTTAATTTATCACATATCACATTAATTGACTTTTTGGTCCACTTTTCCATACGT
TTATATTCTTTTAATCCTGCGTTATCCGTTTCCGTTATATCCAGTGATAGATCGTGCAGGTTAAATAGAATGCT
CTTAAATAATGTCATTTTCTTATCCGCTAAAAATTTAAAGAATGTATAAACCTTTTTCAGAGATTTGAAACTCT
TAGGTGGTGTCCTAGTACACAATATCATAAACAAACTAATAAACATTCCACATTCAGATTCCAACAGCTGATT
AACTTCTACATTAATACAGCCTATTTTCGCTCCAAATGTACATTCGAAAAATCTGAATAAAACATCGATGTCA
CAATTTGTATTATCCAATACAGAATGTCTGTGATTCGTGTTAAAACCATCGGAGAAGGAATAGAAATAAAAA
TTATTATAGTGGTGGAATTCAGTTGGAATATTGCCTCCGGAGTCATAAAAGGATACTAAACATTGTTTTTTAT
CATAAATTACACATTTCCAATGAGACAAATAACAAAATCCAAACATTACAAATCTAGAGGTAGAACTTTTAAT
TTTGTCTTTAAGTATATACGATAAGATATGTTTATTCATAAACGCGTCAAATTTTTCATGAATCGCTAAGGAGT
TTAAGAATCTCATGTCAAATTGTCCTATATAATCCACTTCGGATCCATAAGCAAACTGAGAGACTAAGTTCTT

<div align="center">*FIG.15T*</div>

AATACTTCGATTGCTCATCCAGGCTCCTCTCTCAGGCTCTATTTTCATCTTGACGACCTTTGGATTTTCACCA
GTATGTATTCCTTTACGTGATAAATCATCGATTTTCAAATCCATTTGTGAGAAGTCTATCGCCTTAGATACTTT
TTCCCGTAGTCGAGGTTTAAAGAAATACGCTAACGGTATACTAGTAGGTAACTCAAAGACATCATATATAGA
ATGGTAACGCGTCTTTAACTCGTCGGTTAACTCTTTCTTTTGATCGAGTTCGTCGCTACTATTGGGTCTGCTC
AGGTGCCCCAACTCTACTAGTTCCAACATCATACCGATAGGAATACAAGACACTTTGCCAGCGGTTGTAGAT
TTATCATATTTCTCCACTACATATCCGTTACAATTTGTTAAAAATTTAGATACATCTATATTGCTACATAATCCAG
CTAGTGAATATATATGACATAATAAATTGGTAAATCCTAGTTCTGGTATTTTACTAATTACTAAATCTGTATATCT
TTCCATTTATCATGGAAAAGAATTTACCAGATATCTTCTTTTTTCCAAACTGCGTTAATGTATTCTCTTACAAA
TATTCACAAGATGAATTCAGTAATATGAGTAAAACGGAACGTGATAGTTTCTCATTGGCCGTGTTTCCAGTT
ATAAAACATAGATGGCATAACGCACACGTTGTAAAACATAAAGGAATATACAAAGTTAGTACAGAAGCACG
TGGAAAAAAAGTATCTCCTCCATCACTAGGAAAACCCGCACACATAAACCTAACCGCGAAGCAATATATATA
CAGTGAACACACAATAAGCTTTGAATGTTATAGTTTTCTAAAATGTATAACAAATACAGAAATCAATTCGTTC
GATGAGTATATATTAAGAGGACTATTAGAAGCTGGTAATAGTTTACAGATATTTTCCAATTCCGTAGGTAAAC
GAACAGATACTATAGGTGTACTAGGGAATAAGTATCCATTTAGCAAAATTCCATTGGCCTCATTAACTCCTAA
AGCACAACGAGAGATATTTTCAGCGTGGATTTCTCATAGACCTGTAGTTTTAACTGGAGGAACTGGAGTGG
GTAAGACGTCACAGGTACCCAAGTTATTGCTTTGGTTTAATTATTTATTTGGTGGATTCTCTACTCTAGATAA
AATCACTAACTTTCACGAAAGACCAGTCATTCTATCTCTTCCTAGGATAGCTTTAGTTAGATTGCATAGCAAT
ACCATTTTAAAATCATTGGGATTTAAGGTACTAGATGGATCTCCTATTTCTTTACGGTACGGATCTATACCGG
AAGAATTAATAAACAAACAACCAAAAAAATATGGAATTGTATTTTCTACCCATAAGTTATCTCTAACAAAACT
ATTTAGTTATGGCACTCTTATTATAGACGAAGTTCATGAGCATGATCAAATAGGAGATATTATTATAGCAGTA
GCGAGAAAGCATCATACGAAAATAGATTCTATGTTTTTAATGACTGCCACGTTAGAGGATGACCGAGAACG
GCTAAAAGTATTTTTACCTAATCCCGCATTTATACATATTCCTGGAGATACACTGTTTAAAATTAGCGAGGTAT
TTATTCATAATAAGATAAATCCATCTTCCAGAATGGCATACATAGAAGAAGAAAAGAGAAATTTAGTTACTG
CTATACAGATGTATACTCCTCCTGATGGATCATCCGGTATAGTCTTTGTGGCATCCGTTGCACAGTGTCACGA
ATATAAATCATATTTAGAAAAAAGATTACCGTATGATATGTATATTATTCATGGTAAGGTCTTAGATATAGACGA
AATATTAGAAAAAGTGTATTCATCACCTAATGTATCGATAATTATTTCTACTCCTTATTTGGAATCCAGCGTTAC
TATACGCAATGTTACACACATTTATGATATGGGTAAAGTTTTTGTCCCCGCTCCTTTTGGAGGATCGCAAGA
ATTTATTTCTAAATCTATGAGAGATCAACGAAAAGGAAGAGTAGGAAGAGTTAATCCTGGTACATACGTCTA
TTTCTATGATCTGTCTTATATGAAGTCTATACAGCGAATAGATTCAGAATTTCTACATAATTATATATTGTACGC
TAATAAGTTTAATCTAACACTCCCCGAAGATTTGTTTATAATCCCTACAAATTTGGATATTCTATGGCGTACAA
AGGAATATATAGACTCGTTCGATATTAGTACAGAAACATGGAATAAATTATTATCCAATTATTATATGAAGATG
ATAGAGTATGCTAAACTTTATGTACTAAGTCCTATTCTCGCTGAGGAGTTGGATAACTTTGAGAGGACGGGA
GAATTAACTAGTATTGTACGAGAAGCCATTTTATCTCTAAATTTACGAATTAAGATTTTAAATTTTAAACATAA
AGATGATGATACGTATATACACTTTTGTAAAATATTATTCGGTGTCTATAACGGAACAAACGCTACTATATATTA
TCATAGACCTCTAACGGGATATATGAATATGATTTCAGATACTATATTTGTTCCTGTAGATAATAACTAAAAATC
AAACTCTAATGACCACATCTTTTTTTAGAGATGAAAAATTTTCCACATCTCCTTTTGTAGACACGACTAAACA
TTTTGCAGAAAAAAGTTTATTAGTGTTTAGATAATCGTATACTTCATCAGTGTAGATAGTAAATGTGAACAGA
TAAAAGGTATTCTTGCTCAATAGATTGGTAAATTCCATAGAATATATTAATCCTTTCTTCTTGAGATCCCACAT
CATTTCAACCAGAGACGTTTTATCCAATGATTTACCTCGTACTATACCACATACAAAACTAGATTTTGCAGTG
ACGTCGTACCTGGTATTCCTACCAAACAAAATTTTACTTTTAGTTCTTTTAGAAAATTCTAAGGTAGAATCTC
TATTTGCCAATATGTCATCTATGGAATTACCACTAGCAAAAAATGATAGAAATATATATTGATACATCGCAGCT
GGTTTTGATCTACTATACTTTAAAAACGAATCAGATTCCATAATTGCCTGTATATCATCAGCTGAAAAACTATG
TTTTACACGTATTCCTTCGGCATTTCTTTTTAATGATATATCTTGTTTAGACAATGATAAAGTTATCATGTCCAT
GAGAGACGCGTCTCCGTATCGTATAAATATTTCATTAGATGTTAGACGCTTCATTAGGGGTATACTTCTATAA

<div align="center">*FIG.15U*</div>

GGTTTCTTAATTAGTCCATCATTTGTTGCGTCAAGAACTACTATCGGATGTTGTTGGGTATCTCTAGTGTTAC
ACATGGCCTTACTAAAGTTTGGGTAAATAACTATGATATCTCTATTAATTATAGATGCATATATTTCATTTGTCA
AGGATATTAGTATCGACTTGCTATCGTCATTAATACGTGTAATGTAATCATATAAATCATGCGATAGCCAAGGA
AAATTCAAATAGATGTTCATCATATAATCGTCGCTATAATTCATATTAATACTTTGACATTGACTAATTTGTAATA
TAGCCTCGCCACGAAGAAAGCTCTCGTATTCAGTTTCATCGATAAAGGATACCGTTAAATATAACTGGTTGC
CGATAGTCTCATAGTCTATTAAGTGGTAAGTTTCGTACAAATACAGAATCCCTAAAATATTATCTAATGTTGGA
TTAATCTTTACCATAACTGTATAAAATGGAGACGGAGTCATAACTATTTTACCGTTTGTACTTACTGGAATAG
ACGAAGGAATAATCTCCGGACATGCTGGTAAAGACCCAAATGTCTGTTTGAAGAAATCCAATGTTCCAGGT
CCTAATCTCTTAACAAAAATTACGATATTCGATCCCGATATCCTTTGCATTCTATTTACCAGCATATCACGAACT
ATATTAAGATTATCTATCATGTCTATTCTCCCACCGTTATATAAATCGCCTCCGCTAAGAAACGTTAGTATATCC
ATACAATGGAATACTTCATTTCTAAAATAGTATTCGTTTTCTAATTCTTTAATGTGAAATCGTATACTAGAAAG
GGAAAAATTATCTTTGAGTTTTCCGTTAGAAAAGAACCACGAAACTAATGTTCTGATTGCGTCCGATTCCGT
TGCTGAATTAATGGATTTACACCAAAAACTCATATAACTTCTAGATGTAGAAGCATTCGCTAAAAAATTAGTA
GAATCAAAGGATATAAGTAGATGTTCCAACAAGTGAGCAATTCCCAAGATTTCATCTATATCATTCTCGAATC
CGAAATTAGAAATTCCCAAGTAGATATCCTTTTTCATCCGATCGTTGATGAAAATACGAACTTTATTCGGTAA
GACAATCATTTACTAAGGAGTAAAATAGGAAGTAATGTTCGTATGTCGTTATCATCGTATAAATTAAAGGTGT
GTTTTTTACCATTAAGTGACATTATAATTTTACCAATATTGGAATTATAATATAGGTGTATTTGCGCACTCGCG
ACGGTTGATGCATCGGTAAATATAGCTGTATCTAATGTTCTAGTCGGTATTTCATCATTTCGCTGTCTAATAAT
AGCGTTTTCTCTATCTGTTTCCATTACAGCTGCCTGAAGTTTATTGGTCGGATAATATGTAAAATAATAAGAA
ATACATACGAATAACAAAAATAAAATAAGATATAATAAAGATGCCATTTAGAGATCTAATTTTGTTTAACTTGT
CCAAATTCCTACTTACAGAAGATGAGGAATCGTTGGAGATAGTGTCTTCCTTATGTAGAGGATTTGAAATAT
CTTATGATGACTTGATAACTTACTTTCCAGATAGGAAATACCATAAATATATTTCTAAAGTATTTGAACATGTA
GATTTATCGGAGGAATTAAGTATGGAATTCCATGATACAACTCTGAGAGATTTAGTCTATCTTAGATTGTACA
AGTATTCCAAGTGTATACGGCCGTGTTATAAATTAGGAGATAATCTAAAAGGCATAGTTGTTATAAAGGACA
GGAATATTTATATTAGAGAAGCAAATGATGACTTGATAGAATATCTCCTCAAGGAATACACTCCTCAGATTTA
TACATATTCTAATGAGCGCGTCCCCATAACTGGTTCAAAATTAATTCTTTGTGGATTTTCTCAAGTTACATTTA
TGGCGTATACAACGTCGCATATAACAACAAATAAAAAGGTAGATGTTCTCGTTTCCAAAAATGTATAGATGA
ACTAGTCGATCCAATAAATTATCAAATACTTCAAAATTTATTTGATAAAGGAAGCGGAACAATAAACAAAATA
CTCAGGAAGATATTTTATTCGGTAACCGGTGGCCAAACTCCATAATTTGCTTTTTCTATTTCGGATTTTAGAA
TTTCCAAATTCACCAGCGATTTATCGGTTTTGGTGAAATCCAAGGATTTATTAATGTCCACAAATGCCATTTG
TTTTGTCTGTGGATTGTATTTGAAAATGGAAACGATGTAGTTAGATAGATGCGCTGCAAAGTTTCCTATTAG
GGTTCCGCGCTTTACGTCACCCAGCATACTTGAATCACCATCCTTTAAAAAAAATGATAAGATATCAACATG
GAGTATATCATACTCGGATTTTAATTCTTCTACTGCATCACTGACATTTTCACAAATACTACAATACGGTTTAC
CGAAAATAATCAGTACGTTCTTCATTTATGGGTATCAAAAACTTAAAATCGTTACTGCTGGAAAATAAATCAC
TGACGATATTAGATGATAATTTATACAAAGTATACAATGGAATATTTGTGGATACAATGAGTATTTATATAGCC
GTCGCCAATTGTGTCAGAAACTTAGAAGAGTTAACTACGGTATTCATAAAATACGTAAACGGATGGGTAAA
AAAGGGAGGGCATGTAACCCTTTTTATCGATAGAGGAAGTATAAAAATTAAACAAGACGTTAGAGACAAG
AGACGTAAATATTCTAAATTAACCAAGGACAGAAAATGCTAGAATTAGAAAGTGTACATCCGAAATACA
AAATGTTACCGGATTTATGGAAGAAGAAATAAAGGCAGAAATGCAATTAAAAATCGATAAACTCACATTTC
AAATATATTTATCTGATTCTGATAACATAAAAATATCATTGAATGAGATACTAACACATTTCAACAATAATGAG
AATGTTACATTATTTTATTGTGATGAACGAGACGCAGAATTCGTTATGTGTCTCGAGGCTAAAACACATTTCT
CTACCACAGGAGAATGGCCGTTGATAATAAGTACCGATCAGGATACTATGCTATTTGCATCTACTGATAATCA
TCCTAAGATGATAAAAAACTTAACTCAACTGTTTAAATTTGTTCCCTCGGCAGAGGATAACTATTTAGCAAA
ATTAACGGCGTTAGTGAATGGATGTGATTTCTTTCCTGGACTCTATGGGGCATCTATAACACCCACCAACTTA

*FIG.15V*

```
AACAAAATACAATTGTTTAGTGATTTTACAATCGATAATATAGTCACTAGTTTGGCAATTAAAAATTATTATAG
AAAGACTAACTCTACCGTAGACGTGCGTAATATTGTTACGTTTATAAACGATTACGCTAATTTAGACGATGTC
TACTCGTATGTTCCTCCTTGTCAATGCACTGTTCAAGAATTTATATTTTCCGCATTAGATGAAAAATGGAACA
ATTTTAAATCATCTTATTTAGAGACCGTTCCGTTACCCTGCCAATTAATGTATGCATTAGAACCACGCAAGGA
GATTGATGTTTCAGAAGTTAAAACTTTATCATCTTATATAGATTTCGAAAATACTAAATCAGATATCGATGTTA
TAAAATCTATATCTTCGATCTTCGGATATTCTAACGAAAACTGTAACACTATAGTGTTCGGCATCTATAAGGAT
AATTTACTACTGAGTATAAATAGTTCATTTTACTTTAACGATAGTCTGTTAATAACCAATACTAAAAGTGATAA
TATAATAAATATAGGTTACTAGATTAAAAATGGTGTTCCAACTCGTGTGCTCTACATGCGGCAAAGATATTTC
TCACGAACGATATAAATTGATTATACGAAAAAAATCATTAAAGGATGTACTCGTCAGTGTAAAGAACGAATG
TTGTAGGTTAAAATTATCTACACAAATAGAACCTCAACGTAACTTAACAGTGCAACCTCTATTGGATATAAAC
TAATATGGATCCGGTTAATTTTATCAAGACATATGCGCCTAGAGGTTCTATTATTTTTATTAATTATACCATGTC
ATTAACAAGTCATTTGAATCCATCGATAGAAAAACATGTGGGTATTTATTATGGTACGTTATTATCGGAACAC
TTGGTAGTTGAATCTACCTATAGAAAAGGAGTTCGAATAGTCCCATTGGATAGTTTTTTTGAAGGATATCTTA
GTGCAAAAGTATACATGTTAGAGAATATTCAAGTTATGAAAATAGCAGCTGATACGTCATTAACTTTATTGGG
TATTCCGTATGGATTTGGTCATGATAGAATGTATTGTTTTAAATTGGTAGCTGAATGTTATAAAAATGCCGGTA
TTGATACATCGTCTAAACGAATATTAGGTAAAGATATTTTTCTGAGCCAAAACTTCACAGATGATAATAGATG
GATAAAGATATATGATTCTAATAATTTAACATTTTGGCAAATTGATTACCTTAAAGGGTGAGTTAATATGCATA
ACTACTCCTCCGTTGTTTTTTCCCTCGTTCTTTTTCTTAACGTTGTTTGCCATCACTCTCATAATGTAAAGATAT
TCTAAAATGGTAAACTTTTGCATATCGGACGCAGAAATTGGTATAAATGTTGTAATTGTATTATTTCCCGTCA
ATGGACTAGTCACAGCTCCATCAGTTTTATATCCTTTAGAGTATTTCTCACTCGTGTCTAACATTCTAGAGCAT
TCCATGATCTGTTTATCGTTGATATTGGCCGGAAAGATAGATTTTTTATTTTTTATTATATTACTATTGGCAATT
GTAGATATAACTTCTGGTAAATATTTTTCTACCTTTTCAATCTCTTCTATTTTCAAGCCGGCTATATATTCTGCT
ATATTGTTGCTAGTATCAATACCTTTTCTGGCTAAGAAGTCATATGTGGTATTCACTATATCAGTTTTAACTGG
TAGTTCCATTAGCCTTTCCACTTCTGCAGAATAATCAGAAATTGGTTCTTTACCAGAAAATCCAGCTACTATA
ATAGGCTCACCGATGATCATTGGCAAAATCCTATATTGTACCAGATTAATGAGAGCATATTTCATTTCCAATAA
TTCTGCTAGTTCTTGAGACATTGATTTATTTGATGAATCTAGTTGGTTCTCTAGATACTCTACCATTTCTGCCG
CATACAATAACTTGTTAGATAAAATCAGGGTTATCAAAGTGTTTAGCGTGGCTAGAATAGTGGGCTTGCATG
TATTAAAGAATGCGGTAGTATGAGTAAACCGTTTTAACGAATTATATAGTCTCCAGAAATCTGTGGCGTTACA
TACATGAGCCGAATGACATCGAAGATTGTCCAATATTTTTAATAGCTGCTCTTTGTCCATTATTTCTATATTTG
ACTCGCAACAATTGTAGATACCATTAATCACCGATTCCTTTTTCGATGCCGGACAATAGCACAATTGTTTAGC
TTTGGACTCTATGTATTCAGAATTAATAGATATATCTCTTAATACAGATTGCACTATACATTTTGAAACTATGTC
AAAAATTGTAGAACGACGCTGTTCTGCAGCCATTTAACTTTAAATAATTTACAAAAATTTAAAATGAGCATC
CGTATAAAAATCGATAAACTGCGCCAAATTGTGGCATATTTTTCAGAGTTCAGTGAAGAAGTATCTATAAAT
GTAGACTCGACGGATGAGTTAATGTATATTTTTGCCGCCTTGGGCGGATCTGTAAACATTTGGGCCATTATA
CCTCTCAGTGCATCAGTGTTCTACCGCGGAGCCGAAAACATTGTGTTTAATCTTCCTGTGTCCAAGGTAAAA
TCGTGTTTGTGTAGTTTTCACAATGATGCCATCATAGATATAGAACCTGATCTGGAAAATAATCTAGTAAAAC
TTTCTAGTTATCATGTAGTAAGTGTCGATTGTAACAAGGAACTGATGCCTATTAGGACAGATACTACTATTTG
TCTAAGTATAGATCAAAAGAAATCTTACGTGTTTAATTTTCACAAGTATGAAGAAAATGTTGTGGTAGAAC
CGTCATTCATTTAGAATGGTTGTTGGCTTTATCAAGTGTATTAGTCAGCATCAGCATTTGGCTATTATGTTTAA
AGATGACAATATTATTATGAAGACTCCTGGTAATACTGATGCGTTTTCCAGGGAATATTCTATGACTGAATGT
TCTCAAGAACTACAAAAGTTTTCTTTCAAAATAGCTATCTCGTCTCTCAACAAACTACGAGGATTCAAAAAG
AGAGTCAATGTTTTTGAAACTAGAATCGTAATGGATAATGACGATAACATTCTAGGAATGTTGTTTTCGGAT
AGAGTTCAATCCTTTAAGATCAACATCTTTATGACGTTTTTAGATTAATACTTTCAATGAGATAAATATGGGT
GGCGGAGTAAGTGTTGAGCTCCCTAAACGGGATCCGCCTCCGGGAGTACCCACTGATGAGATGTTATTAA
```

<div align="center">

*FIG.15W*

</div>

ACGTGGATAAAATGCATGACGTGATAGCTCCCGCTAAGCTTTTAGAATATGTGCATATAGGACCACTAGCAA
AAGATAAAGAGGATAAAGTAAAGAAAAGATATCCAGAGTTTAGATTAGTCAACACAGGACCCGGTGGTCT
TTCGGCATTGTTAAGACAATCGTATAATGGAACCGCACCCAATTGCTGTCGCACTTTTAATCGTACTCATTAT
TGGAAGAAGGATGGAAAGATATCAGATAAGTATGAAGAGGGTGCAGTATTAGAATCGTGTTGGCCAGACG
TTCACGACACCGGAAAATGCGATGTTGATTTATTCGACTGGTGTCAGGGGGATACGTTCGATAGAAACATA
TGCCATCAGTGGATCGGTTCAGCCTTTAATAGGAGTAATAGAACTGTAGAGGGTCAACAATCGTTAATAAAT
CTGTATAATAAGATGCAAACATTATGTAGTAAAGATGCTAGTGTACCAATATGTGAATCATTTTTGCATCATTT
ACGCGCACACAATACAGAAGATAGCAAAGAGATGATCGATTATATTCTAAGACAACAGTCTGCGGACTTTA
AACAGAAATATATGAGATGTAGTTATCCCACTAGAGATAAGTTAGAAGAGTCATTAAAATATGCGGAACCTC
GAGAATGTTGGGATCCAGAGTGTTCGAATGCCAATGTTAATTTCTTGCTAACACGTAATTATAATAATTTAGG
ACTTTGCAATATTGTACGATGTAATACTAGCGTGAACAACTTACAGATGGATAAAACTTCCTCATTAAGATTG
TCATGTGGATTAAGCAATAGTGATAGATTTTCTACTGTTCCCGTCAATAGAGCAAAAGTAGTTCAACATAATA
TTAAACACTCGTTCGACCTAAAATTGCATTTGATCAGTTTATTATCTCTCTTGGTAATATGGATACTAATTGTA
GCTATTTAAATGGGTGCCGCGGCAAGCATACAGACGACGGTGAATACACTCAGCGAACGTATCTCGTCTAA
ATTAGAACAAGAAGCGAATGCTAGTGCTCAAACAAAATGTGATATAGAAATCGGAAATTTTTATATCCGACA
AAACCATGGATGTAACCTCACTGTTAAAAATATGTGCTCTGCGGACGCGGATGCTCAGTTGGATGCTGTGTT
ATCAGCCGCTACAGAAACATATAGTGGATTAACACCGGAACAAAAAGCATACGTGCCAGCTATGTTTACTG
CTGCGTTAAACATTCAGACGAGTGTAAACACTGTTGTTAGAGATTTTGAAAATTATGTGAAACAGACTTGTA
ATTCTAGCGCGGTCGTCGATAACAAATTAAAGATACAAAACGTAATCATAGATGAATGTTACGGAGCCCCAG
GATCTCCAACAAATTTGGAATTTATTAATACAGGATCTAGCAAAGGAAATTGTGCCATTAAGGCGTTGATGC
AATTGACGACTAAGGCCACTACTCAAATAGCACCTAAACAAGTTGCTGGTACAGGAGTTCAGTTTTATATGA
TTGTTATCGGTGTTATAATATTGGCAGCGTTGTTTATGTACTATGCCAAGCGTATGTTGTTCACATCCACCAAT
GATAAAATCAAACTTATTTTAGCCAATAAGGAAAACGTCCATTGGACTACTTACATGGACACATTCTTTAGA
ACTTCTCCGATGGTTATTGCTACCACGGATATGCAAAACTGAAAATATATTGATAATATTTTAATAGATTAACA
TGGAAGTTATCACTGATCGTCTAGACGATATAGTGAAACAAAATATAGCGGATGAAAAATTTGTAGATTTTG
TTATACACGGTCTAGAGCATCAATGTCCTGCTATACTTCGACCATTAATTAGGTTGTTTATTGATATACTATTAT
TTGTTATAGTAATTTATATTTTTACGGTACGTCTAGTAAGTAGAAATTATCAAATGTTGTTGGCGTTGGTGGC
GCTAGTCATCACATTAACTATTTTTATTACTTTATACTATAATAGTACTAGACTGACTTCTAACAAACATCTCAC
CTGCCATAAATAAATGCTTGATATTAAAGTCTTCTATTTCTAACACTATTCCATCTGTGGAAAATAATACTCTG
ACATTATCGCTAATTGACACATCGGTGAGTGATATGCCTATAAAGTAATAATCTTCTTTGGGCACATATACCAG
TGTACCAGGTTCTAACAACCTATTTACTGGTGCTCCTATAGCATACTTTTTCTTTACCTTGAGAATATCCATCG
TTTGCTTGGTCAATAGCGATATGTGATTTTTATCAACCACTCGAAAAAGTAATTGGAGTGTTCATATCCTCTA
CGGGCTATTGTCTCATGGCCGTGTATGAAATTTAAGTAACACGACTGTGGTAGATTTGTTCTATAGAGCCGG
TTGCCGCAAATAGATAGAACTACCAATATGTCTGTACAAATGTTAAACATTAATTGATTAACAGAAAACAAT
GTTCGTTCTGGGAATAGAAACCAGATCAAAACAAAATTCGTTAGAATATATGCCACGTTTATACATTGAATAT
AAAATAACTACAGTTTGAAAAATAACAGTATCATTTAAACATTTAACTTGCGGGGTTAATCTCACAACTTTAC
TGTTTTTGAACTGTTCAAAATATAGCATAGATCCGTGAGAAATACGTTTAGCCGCCTTTAATAGAGGAAATC
CCACCGCCTTTCTGGATCTCACCAACGACGATAGTTCTGACCAGCAACTCATTTCTTCATCATCCACCTGTTT
TAACATATAATAGGCAGGAGATAGATATCCGTCATTGCAATATTCCTTCTCGTAGGCACACAATCTAATATTGA
TAAAATCTCCATTCTCTTCTCTGCATTTATTATCTTGTTTCGGTGGCTGATTAGGCTGTAGTCTTGGTTTAGGC
TTTGGTATATCGTTGTTGAATCTATTTTGGTCATTAAATCTTTCATTTCTTCCTGGTATATTTTATCACCTCGTT
TGGTTGGATTTTTGTCTATATTATCGTTTGTAACATCGGTACGGGTATTCATTTATCACAAAAAAAACTTCTCT
AAATGAGTCTACTGCTAGAAAACCTCATCGAAGAAGATACCATATTTTTTGCAGGAAGTATATCTGAGTATG
ATGATTTACAAATGGTTATTGCCGGCGCAAAATCCAAATTTCCAAGATCTATGCTTTCTATTTTTAATATAGTA

FIG.15X

CCTAGAACGATGTCAAAATATGAGTTGGAGTTGATTCATAACGAAAATATCACAGGAGCAATGTTTACCACA
ATGTATAATATAAGAAACAATTTGGGTCTAGGAGATGATAAACTAACTATTGAAGCCATTGAAAACTATTTCT
TGGATCCTAACAATGAAGTTATGCCTCTTATTATTAATAATACGGATATGACTGCCGTCATTCCTAAAAAAAGT
GGTAGGAGAAAGAATAAGAACATGGTTATCTTCCGTCAAGGATCATCACCTATCTTGTGTATTTTCGAAACT
CGTAAAAAGATTAATATTTATAAAGAAAATATGGAATCCGCGTCGACTGAGTATACACCTATCGGAGACAAC
AAGGCTTTGATATCTAAATATGCGGGAATTAATGTCCTGAATGTGTATTCTCCTTCCACATCCATGAGATTGA
ATGCCATTTACGGATTCACCAATAAAAATAAACTAGAGAAACTTAGTACTAATAAGGAACTAGAATCGTATA
GTTCTAGCCTCTTCAAGAACCCATTAGGTTAAATGATTTTCTGGGACTATTGGAATGTGTTAAAAAGAATATT
CCTCTAACAGATATTCCGACAAAGGATTGATTACTATAAATGGAGAATGTTCCTAATGTATACTTTAATCCTGT
GTTTATAGAGCCCACGTTTAAACATTCTTTATTAAGTGTTTATAAACACAGATTAATAGTTTTATTTGAAGTAT
TCGTTGTATTCATTCTAATATATGTATTTTTTAGATCTGAATTAAATATGTTCTTTATGCCTAAACGAAAAATAC
CCGATCCTATTGATAGATTACGACGTGCTAATCTAGCGTGTGAAGACGATAAATTAATGATCTATGGATTACC
ATGGATGACAACTCAAACATCTGCGTTATCAATAAATAGTAAACCGATAGTGTATAAAGATTGTGCAAAGCT
TTTGCGATCAATAAATGGATCACAACCAGTATCTCTTAACGATGTTCTTCGCAGATGATGATTCATTTTTTAA
GTATTTGGCTAGTCAAGATGATGAATCTTCATTATCTGATATATTGCAAATCACTCAATATCTAGACTTTCTGTT
ATTATTATTGATCCAATCAAAAAATAAATTAGAAGCCGTGGGTCATTGTTATGAATCTCTTTCAGAGGAATAC
AGACAATTGACAAAATTCACAGACTTTCAAGATTTTAAAAAACTGTTTAACAAGGTCCCTATTGTTACAGAT
GGAAGGGTCAAACTTAATAAAGGATATTTGTTCGACTTTGTGATTAGTTTGATGCGATTCAAAAAGAATCCT
CTCTAGCTACCACCGCAATAGATCCTATTAGATACATAGATCCTCGTCGTGATATCGCATTTTCTAACGTGATG
GATATATTAAAGTCGAATAAAGTGAACAATAATTAATTCTTTATTGTCATCATGAACGGCGGACATATTCAGT
TGATAATCGGCCCCATGTTTTCAGGTAAAAGTACAGAATTAATTAGACGAGTTAAACGAGCTCAAAAATTG
AAAAACTAGCGTCTTTTTTTGCTCGAAGTCGACCACCATGCCACCTCCTCGCCTCCTCTTCTTCCTCCTCTTC
CTCACCCCATGGAAGTCAGGCCCGAGGAACCTCTAGTGGTGAAGGTGGAAGAGGGAGATAACGCTGTGC
TGCAGTGCCTCAAGGGGACCTCAGATGGCCCCACTCAGCAGCTGACCTGGTCTCGGGAGTCCCCGCTTAA
ACCCTTCTTAAAACTCAGCCTGGGGCTGCCAGGCCTGGGAATCCACATGAGGCCCCTGGCCATCTGGCTTT
TCATCTTCAACGTCTCTCAACAGATGGGGGCTTCTACCTGTGCCAGCCGGGCCCCCCTCTGAGAAGGCCTG
GCAGCCTGGCTGGACAGTCAATGTGGAGGGCAGCGGGGAGCTGTTCCGGTGGAATGTTTCGGACCTAGG
TGGCCTGGGCTGTGGCCTGAAGAACAGGTCCTCAGAGGGCCCCAGCTCCCCTTCCGGGAAGCTCATGAG
CCCCAAGCTGTATGTGTGGGCCAAAGACCGCCCTGAGATCTGGGAGGGAGAGCCTCCGTGTGTCCCACCG
AGGGACAGCCTGAACCAGAGCCTCAGCCAGGACCTCACCATGGCCCCTGGCTCCACACTCTGGCTGTCCT
GTGGGGTACCCCCTGACTCTGTGTCCAGGGCCCCTCTCCTGGACCCATGTGCACCCCAAGGGCCTAAGTCA
TTGCTGAGCCTAGAGCTGAAGGACGATCGCCCTGCCAGAGATATGTGGGTAATGGAGACGGGTCTGTTGT
TGCCCCGGGCCACAGCTCAAGACGCTGGAAAGTATTATTGTCACCGTGGCAACCTGACCATGTCATTCCAC
CTGGAGATCACTGCTCGGCCAGTACTATGGCACTGGCTGCTGAGGACTGGTGGCTGGAAGGTCTCAGCTG
TGACTTTGGCTTATCTGATCTTCTGCCTGTGTTCCCTTGTGGGCATTCTTCATCTTCAAAGAGCCCTGGTCCT
GAGGAGGAAAGATGATTAATTAATTTTTATGGATCCGCTAGCGGCCGCGGAGGTAATGATATGTATCAATC
GGTGTGTAGAAAGTGTTACATCGACTCATAATATTATATTTTTTATCTAAAAAACTAAAAATAAACATTGATTA
AATTTTAATATAATACTTAAAAATGGATGTTGTGTCGTTAGATAAACCGTTTATGTATTTTGAGGAAATTGATA
ATGAGTTAGATTACGAACCAGAAAGTGCAAATGAGGTCGCAAAAAAACTGCCGTATCAAGGACAGTTAAA
ACTATTACTAGGAGAATTATTTTTCTTAGTAAGTTACAGCGACACGGTATATTAGATGGTGCCACCGTAGTGT
ATATAGGATCTGCTCCCGGTACACATATACGTTATTTGAGAGATCATTTCTATAATTTAGGAGTGATCATCAAA
TGGATGCTAATTGACGGCCGCCATCATGATCCTATTTTAAATGGATTGCGTGATGTGACTCTAGTGACTCGG
TTCGTTGATGAGGAATATCTACGATCCATCAAAAAACAACTGCATCCTTCTAAGATTATTTTAATTTCTGATGT
GAGATCCAAACGAGGAGGAAATGAACCTAGTACGGCGGATTTACTAAGTAATTACGCTCTACAAAATGTCA

<p style="text-align:center">FIG.15Y</p>

TGATTAGTATTTTAAACCCCGTGGCGTCTAGTCTTAAATGGAGATGCCCGTTTCCAGATCAATGGATCAAGG
ACTTTTATATCCCACACGGTAATAAAATGTTACAACCTTTTGCTCCTTCATATTCAGCTGAAATGAGATTATTA
AGTATTTATACCGGTGAGAACATGAGACTGACTCGAGTTACCAAATTAGACGCTGTAAATTATGAAAAAAG
ATGTACTACCTTAATAAGATCGTCCGTAACAAAGTAGTTGTTAACTTTGATTATCCTAATCAGGAATATGACTA
TTTTCACATGTACTTTATGCTGAGGACCGTGTACTGCAATAAAACATTTCCTACTACTAAAGCAAAGGTACTA
TTTCTACAACAATCTATATTTCGTTTCTTAAATATTCCAACAACATCAACTGAAAAAGTTAGTCATGAACCAAT
ACAACGTAAAATATCTAGCAAAAATTCTATGTCTAAAAACAGAAATAGCAAGAGATCCGTACGCGGTAATAA
ATAGAAACGTGCTACTGAGATATACTACCGATATAGAGTATAATGATTTAGTTACTTTAATAACCGTTAGACAT
AAAATTGATTCTATGAAAACTGTGTTTCAGGTATTTAACGAATCATCCATAAATTATACTCCGGTTGATGATG
ATTATGGAGAACCAATCATTATAACATCGTATCTTCAAAAAGGTCATAACAAGTTTCCTGTAAATTTTCTATAC
ATAGATGTGGTAATATCTGACTTATTTCCTAGCTTTGTTAGACTAGATACTACAGAAACTAATATAGTTAATAG
TGTACTACAAACAGGTGATGGTAAAAAGACTCTTCGTCTTCCCAAAATGTTAGAGACGGAAATAGTTGTCA
AGATTCTCTATCGCCCTAATATACCATTAAAAATTGTTAGATTTTTCCGCAATAACATGGTAACTGGAGTAGA
GATAGCCGATAGATCTGTTATTTCAGTCGCTGATTAATCAATTAGTAGAGATGAGATAAGAACATTATAATAA
TCAATAATATATCTTATATCTTATATCTTATATCTTATATCTTGTTTAGAAAAATGCTAATATTAAAATAGCTAACG
CTAGTAATCCAATCGGAAGCCATTTGATATCTATAATAGGGTATCTAATTTCCTGATTTAAATAGCGGACAGCT
ATATTCTCGGTAGCTACTCGTTTGGAATCACAAACATTATTTACATCTAATTTACTATCTGTAATGGAAACGTT
TCCCAATGAAATGGTACAATCCGATACATTGCATTTTGTTATATTTTTTTTAAAGAGGCTGGTAACAACGCAT
CGCTTCGTTTACATGGCTCGTACCAACAATAATAGGGTAATCTTGTATCTATTCCTATCCGTACTATGCTTTTAT
CAGGATAAATACATTTACATCGTATATCGTCTTTGTTAGCATCACAGAATGCATAAATTTGTTCGTCCGTCATG
ATAAAATTTAAAGTGTAAATATAACTATTATTTTTATAGTTGTAATAAAAAGGGAAATTTGATTGTATACTTTC
GGTTCTTTAAAAGAAACTGACTTGATAAAAATGGCTGTAATCTCTAAGGTTACGTATAGTCTATATGATCAAA
AGAGATTAATGCTACAGATATTATCATTAGTCATGTTAAAAATGACGACGATATCGGTACCGTTAAAGATGGT
AGACTAGGTGCTATGGATGGGGCATTATGTAAAACTTGTGGGAAAACGGAATTGGAATGTTTCGGTCACT
GGGGTAAAGTAAGTATTTATAAAACTCATATAGTTAAGCCTGAATTTATTTCAGAAATTATTCGTTTACTGAAT
CATATATGTATTCACTGCGGATTATTGCGTTCACGAGAACCGTATTCCGACGATATTAACCTAAAAGAGTTAT
CGGGACACGCTCTTAGGAGATTAAAGGATAAAATATTATCCAAGAAAAAGTCATGTTGGAACAGCGAATGT
ATGCAACCGTATCAAAAAATTACTTTTTCAAAGAAAAAGGTTTGTTTCGTCAACAAGTTGGATGATATTAAC
GTTCCTAATTCTCTCATCTATCAAAAGTTAATTTCTATTCATGAAAAGTTTTGGCCATTATTAGAAATTCATCA
ATATCCAGCTAACTTATTTTATACAGACTACTTTCCCATCCCTCCGCTGATTATTAGACCGGCTATTAGTTTTTG
GATAGATAGTATACCCAAAGAAACCAATGAATTAACTTACTTATTAGGTATGATCGTTAAGAATTGTAACTTG
AATGCTGATGAACAGGTTATCCAGAAGGCGGTAATAGAATACGATGATATTAAAATTATTTCTAATAACACTA
CCAGTATCAATTTATCATATATCACATCCGGCAAAAATAATATGATTAGAAGTTATATCGTCGCCCGGCGAAAA
GATCAGACCGCTAGATCTGTAATTGGTCCCAGTACATCTATCACCGTTAATGAGGTAGGAATGCCCGCATATA
TTAGAAATACACTTACAGAAAGATATTTGTTAATGCCTTTACAGTGGATAAAGTTAAACAACTATTAGCGTC
AAACCAAGTTAAATTTTACTTTAATAAACGATTAAACCAATTAACAAGAATACGCCAAGGAAAGTTTATCAA
AATAAAATACATTTATTGCCTGGTGATTGGGTAGAAGTAGCTGTTCAAGAATATACAAGTATTATTTTTGGAA
GACAGCCGTCTCTACATAGATACAACGTCATCGCTTCATCTATCAGAGCTACCGAAGGAGATACTATCAAAA
TATCTCCCGGAATTGCCAACTCTCAAAATGCTGATTTCGACGGGGATGAGGAATGGATGATATTAGAACAA
AATCCTAAAGCTGTAATTGAACAAAGTATTCTTATGTATCCGACGACGTTACTCAAACACGATATTCATGGAG
CCCCCGTTTATGGATCTATTCAAGATGAAATCGTAGCAGCGTATTCATTGTTTAGGATACAAGATCTTTGTTT
AGATGAAGTATTGAACATCTTGGGAAATATGGAAGAGAGTTCGATCCTAAAGGTAAATGTAAATTCAGCGG
TAAAGATATCTATACTTACTTGATAGGTGAAAAGATTAATTATCCGGGTCTCTTAAAGGATGGTGAAATTATT
GCAAACGACGTAGATAGTAATTTTGTTGTGGCTATGAGGCATCTGTCATTGGCTGGACTCTTATCCGATCAT

*FIG.15Z*

```
AAGTCGAACGTGGAAGGTATCAACTTTATTATCAAGTCATCTTATGTTTTTAAGAGATATCTATCTATTTACGG
TTTTGGGGTGACATTCAAAGATCTGAGACCAAATTCGACGTTCACTAATAAATTGGAGGCCATCAACGTAG
AAAAAATAGAACTTATCAAAGAAGCATACGCCAAATATCTCAACGATGTAAGAGACGGGAAAATAGTTCCA
TTATCTAAAGCTTTAGAGGCGGACTATGTGGAATCCATGTTATCCAACTTGACAAATCTTAATATCCGAGAG
ATAGAAGAACATATGAGACAAACGCTGATAGATGATCCAGATAATAACCTCCTGAAAATGGCCAAAGCGGG
TTATAAAGTAAATCCTACAGAACTAATGTATATTCTAGGTACGTATGGACAACAAAGGATTGATGGTGAACC
AGCAGAGACTCGAGTATTGGGTAGAGTCTTACCTTACTATCTTCCAGACTCTAAGGATCCAGAAGGAAGAG
GTTACATTCTTAATTCTTTAACAAAAGGATTAACGGGTTCTCAATATTACTTTTCGATGCTGGTTGCAAGATC
TCAATCTACTGATATCGTCTGTGAAACATCACGTACCGGAACACTGGCTAGAAAAATCATTAAAAAGATGGA
GGATATGGTGGTCGACGGATACGGACAAGTAGTTATAGGTAATACGCTCATCAAGTACGCCGCCAATTATAC
CAAAATTCTAGGCTCAGTATGTAAACCTGTAGATCTTATCTATCCAGATGAGTCCATGACTTGGTATTTGGAA
ATTAGTGCTCTGTGGAATAAAATAAACAGGGATTCGTTTACTCTCAGAAACAGAAACTTGCAAAGAAGAC
ATTGGCGCCGTTTAATTTCCTAGTATTCGTCAAACCCACCACTGAGGATAATGCTATTAAGGTTAAGGATCTG
TACGATATGATTCATAACGTCATTGATGATGTGAGAGAGAAATACTTCTTTACGGTATCTAATATAGATTTTAT
GGAGTATATATTCTTGACGCATCTTAATCCTTCTAGAATTAGAATTACAAAAGAAACGGCTATCACTATCTTTG
AAAAGTTCTATGAAAAACTCAATTATACTCTAGGTGGTGGAACTCCTATTGGAATTATTTCTGCACAGGTATT
GTCTGAGAAGTTTACACAACAAGCCCTGTCCAGTTTTCACACTACTGAAAAAAGTGGTGCCGTCAAACAA
AAACTTGGTTTCAACGAGTTTAATAACTTGACTAATTTGAGTAAGAATAAGACCGAAATTATCACTCTGGTA
TCCGATGATATCTCTAAACTTCAATCTGTTAAGATTAATTTCGAATTTGTATGTTTGGGAGAATTAAATCCAGA
CATCACTCTTCGAAAAGAAACAGATAGGTATGTAGTAGATATAATAGTCAATAGATTATACATCAAGAGAGC
AGAAATTACCGAATTAGTCGTCGAATATATGATTGAACGATTTATCTCCTTTAGCGTCATTGTAAAGGAATGG
GGTATGGAAACATTCATTGAGGATGAGGATAATATTAGATTTACTGTCTACCTAAATTTCGTTGAACCGGAA
GAATTGAATCTTAGTAAGTTTATGATGGTTCTTCCGGGTGCCGCCAACAAGGGCAAGATTAGTAAATTCAA
GATTCCTATCTCTGACTATACGGGATATGACGACTTCAATCAAACAAAAAAGCTCAATAAGATGACTGTAGA
ACTCATGAATCTAAAAGAATTGGGTTCTTTCGATTTGGAAAACGTCAACGTGTATCCTGGAGTATGGAATAC
ATACGATATCTTCGGTATCGAGGCCGCTCGTGAATACTTGTGCGAAGCCATGTTAAACACCTATGGAGAAG
GGTTCGATTATCTGTATCAGCCTTGTGATCTTCTCGCTAGTTTACTATGTGCTAGTTACGAACCAGAATCAGT
GAATAAATTCAAGTTCGGCGCAGCTAGTACTCTTAAGAGAGCTACGTTCGGAGACAATAAAGCATTGTTAA
ACGCGGCTCTTCATAAAAAGTCAGAACCTATTAACGATAATAGTAGCTGCCACTTTTTTAGCAAGGTCCCTA
ATATAGGAACTGGATATTACAAATACTTTATCGACTTGGGTCTTCTCATGAGAATGGAAAGGAAACTATCTG
ATAAGATATCTTCTCAAAAGATCAAGGAAATGGAAGAAACAGAAGACTTTTAATTCTTATCAATAACATATTT
TTCTATGATCTGTCTTTTAAACGATGGATTTTCCACAAATGCGCCTCTCAAGTCCCTCATAGAATGATACACG
TATAAAAAATATAGCATAGGCAATGACTCCTTATTTTTAGACATTAGATATGCCAAAATCATAGCCCCGCTTCT
ATTTACTCCCGCAGCACAATGAACCAACACGGGCTCGTTTCGTTGATCACATTTAGATAAAAAGGCGGTTA
CGTCGTCAAAATATTTACTAATATCGGTAGTTGTATCATCTACCAACGGTATATGAATAATATTAATATTAGAGT
TAGGTAATGTATATTTATCCATCGTCAAATTTAAAACATATTTGAACTTAACTTCAGATGATGGTGCATCCATA
GCATTTTTATAATTTCCCAAATACACATTATTGGTTACCCTTGTCATTATAGTGGGAGATTTGGCTCTGTGCAT
ATCTCCAGTTGAACGTAGTAGTAAGTATTTATACAAACTTTTCTTATCCATTTATAACGTACAAATGGATAAAA
CTACTTTATCGGTAAACGCGTGTAATTTAGAATACGTTAGAGAAAAGGCTATAGTAGGCGTACAAGCAGCC
AAAACATCAACACTTATATTCTTTGTTATTATATTGGCAATTAGTGCGCTATTACTCTGGTTTCAGACGTCTGA
TAATCCAGTCTTTAATGAATTAACGAGATATATGCGAATTAAAAATACGGTTAACGATTGGAAATCATTAACG
GATAGCAAAACAAAATTAGAAAGTGATAGAGGTAGACTTCTAGCCGCTGGTAAGGATGATATATTCGAATT
CAAATGTGTGGATTTCGGCGCCTATTTTATAGCTATGCGATTGGATAAGAAAACATATCTGCCGCAAGCTATT
AGGCGAGGTACTGGAGACGCGTGGATGGTTAAAAAGGCGGCAAAGGTCGATCCATCTGCTCAACAATTTT
```

<div align="center">FIG.15AA</div>

GTCAGTATTTGATAAAACACAAGTCTAATAATGTTATTACTTGTGGTAATGAGATGTTAAATGAATTAGGTTAT
AGCGGTTATTTTATGTCACCGCATTGGTGTTCCGATTTTAGTAATATGGAATAGTGTTAGATAAATGCGGTAA
CGAATGTTCCTGTAAGGAACCATAACAGTTTAGATTTAACGTTAAAGATGAGCATAAACATAATAAACAAAA
TTACAATCAAACCTATAACATTAATATCAAACAATCCAAAAAATGAAATCAGTGGAGTAGTAAACGCGTACAT
AACTCCTGGATAACGTTTAGTAGCTGCCGTTCCTATTCTAGACCAAAAATTCGGTTTCATGTTTTCGAAACG
GTGTTCTGCAACAAGTCGGGGATCGTGTTCTACATATTTGGCGGCATTATCCAGTATCTGCCTATTGATCTTC
ATTTCGTTTTCAATTCTGGCTATTTCAAAATAAAATCCCGATGATAGACCTCCAGACTTTATAATTTCATCTAC
GATGTTCAGCGCCGTAGTAACTCTAATAATATAGGCTGATAAGCTAACATCATACCCTCCTGTATATGTGAATA
TGGCATGATTTTTGTCCATTACAAGCTCGGTTTTAACTTTATTGCCTGTAATAATTTCTCTCATCTGTAGGATA
TCTATTTTTTTGTCATGCATTGCCTTCAAGACGGGACGAAGAAACGTAATATCCTCAATAACGTTATCGTTTT
CTACAATAACTACATATTCTACCTTTTTATTTTCTAACTCGGTAAAAAAATTAGAATCCCATAGGGCTAAATGT
CTAGCGATATTTCTTTTCGTTTCCTCTGTACACATAGTGTTACAAAACCCTGAAAAGAAGTGAGTATACTTGT
CATCATTTCTAATGTTTCCTCCAGTCCACTGTATAAACGCATAATCCTTGTAATGATCTGGATCATCCTTGACTA
CCACAACATTTCTTTTTTCTGGCATAACTTCGTTGTCCTTTACATCATCGAACTTCTGATCATTAATATGCTCAT
GAACATTAGGAAATGTTTCTGATGGAAGTCTATCAATAACTGGCACAACAATAACAGGAGTTTTCGCCGCC
GCCATTTAGTTATTGAAATTAATCATATACAACTCTTTAATACGAGTTATATTTTCGTCTATCCATTGTTTCACAT
TTACATATTTCGACAAAAAGATATAAAATGCGTATTCCAATGCTTCTCTGTTAATGAATTACTAAAATATACA
AACACGTCACTGTCTGGCAATAAATGATATCTTAGAATATTGTAACAATTTATTTTGTATTGCACATGTTCGTG
ATCTATGAGTTCTTCTTCGAATGGCATAGGATCTCCGAATCTGAAAACGTATAAATAGGAGTTAGAATAATAA
TATTTGAGAGTATTGGTAATATATAAACTCTTTAGCGGTATAATTAGTTTTTTTTCTCTCAATTTCTATTTTTAGA
TGTGATGGAAAAATGACTAATTTTGTAGCATTAGTATCATGAACTCTAATCAAAATCTTAATATCTTCGTCACA
CGTTAGCTCTTTGAAGTTTTTAAGAGATGCATCAGTTGGTTCGACCGATGGAGTAGGTGCAACAATTTTTT
GTTCGATGTATGTATGTACTGGAGCCATTGTTTTAACTATAATGGTGCTTGTATCGAAAAACTTTAATGCAGA
TAGCGGAAGCTCTTCGCCGCGACTTTCTACATCGTAATTGGGTTCTAACGCCGATCTCTGAATGGATACTAG
TTTTCTAAGTTCTAATGTGATTCTCTGAAAATGTAAATCCAATTCCTCCGGCATTATAGATGTGTATACATCGG
TAAATAAAACTATAGTATCCAACGATCCCTTCTCGCAAATTCTAGTCTTAACCAAAAAATCGTATATAACCACG
GAGATGGCGTATTTAAGAGTGGATTCTTCTACCGTTTTGTTCTTGGATGTCATATAGGAAACTATAAAGTCC
GCACTACTGTTAAGAATGATTACTAACGCAACTATATAGTTCAAATTAAGCATTTTGGAAACATAAAATAACT
CTGTAGACGATACTTGACTTTCGAATAAGTTTGCAGACAAACGAAGAAAGAACAGACCTCTCTTAATTTCA
GAAGAAAACTTTTTTTCGTATTCCTGACGTCTAGAGTTTATATCAATAAGAAAGTTAAGAATTAGTCGGTTA
ATGTTGTATTTCATTACCCAAGTTTGAGATTTCATAATATTATCAAAAGACATGATAATATTAAAGATAAAGCG
CTGACTATGAACGAAATAGCTATATGGTTCGCTCAAAAATATAGTCTTGTTAAACGTGGAAACGATAACTGT
ATTTTTAATCACGTCAGCGGCATCTAAATTAAATATAGGTATATTTATTCCACACACTCTACAATATGCCACAC
CATCTTCATAATAAATAAATTCGTTAGCAAAATTATTAATTTTAGTGAAATAGTTAGCGTCAACTTTCATAGCT
TCCTTCAATCTAATTTGATGCTCACACGGTGCGAATTCCACTCTAACATCCCTTTTCCATGCCTCAGGTTCATC
GATCTCTATAATATCTAGTTTTTTGCGTTTCACAAACACAGGCTCGTCTCTCGCGATGAGATCTGTATAGTAA
CTATGTAAATGATAACTAGATAGAAAGATGTAGCTATATAGATGACGATCCTTTAAGAGAGGTATAATAACTT
TACCCCAATCAGATAGACTGTTGTTATGGTCTTCGGAAAAGAATTTTTATAAATTTTTCCAGTATTTTCCAA
ATATACGTACTTAACATCTAAAAAATCCTTAATGATAATAGGAATGGATAATCCGTCTATTTTATAAAGAAATA
CATATCGCACATTATACTTTTTTTTTGGAAATGGGAATACCGATGTGTCTACATAAATATGCAAAGTCTAAATAT
TTTTTAGAGAATCTTAATTGGTCCAAATTCTTTTCCAAGTACGGTAATAGATTTTTCATATTGAACGGTATCTT
CTTAATCTCTGGTTCTAGTTCCGCATTAAATGATGAAACTAAGTCACTATTTTTATAACTAACGATTACATCAC
CTCTAACATCATCATTTACCAGAATACTGATCTTCTTTTGTCGTAAATACATGTCTAATGTGTTAAAAAAAGA
TCATACAAGTTATACGTCATTTCATCTGTGGTATTCTTGTCATTGAAGGATAAACTCGTACTAATCTCTTCTTTA

<div style="text-align:center">*FIG.15AB*</div>

ACAGCCTGTTCAAATTTATATCCTATATACGAAAAAATAGCAACCAGTGTTTGATCATCCGCGTCAATATTCTG
TTCTATCGTAGTGTATAACAATCGTATATCTTCTTCTGTGATAGTCGATACGTTATAAAGGTTGATAACGAAAA
TATTTTTATTTCGTGAAATAAAGTCATCGTAGGATTTTGGACTTATATTCGCGTCTAGTAGATATGCTTTTATTT
TTGGAATGATCTCAATTAGAATAGTCTCTTTAGAGTCCATTTAAAGTTACAAACAACTAGGAAATTGGTTTAT
GATGTATAATTTTTTTAGTTTTTATAGATTCTTTATTCTATACTTAAAAAATGAAAATAAATACAAAGGTTCTTG
AGGGTTGTGTTAAATTGAAAGCGAGAAATAATCATAAATTATTTCATTATCGCGATATCCGTTAAGTTTGTAT
CGTAATGGCGTGGTCAATTACGAATAAAGCGGATACTAGTAGCTTCACAAAGATGGCTGAAATCAGAGCTC
ATCTAAAAAATAGCGCTGAAAATAAAGATAAAAACGAGGATATTTCCCGGAAGATGTAATAATTCCATCTA
CTAAGCCCAAAACCAAACGAGCCACTACTCCTCGTAAACCAGCGGCTACTAAAAGATCAACCAAAAAGGA
GGAAGTGGAAGAAGAAGTAGTTATAGAGGAATATCATCAAACAACTGAAAAAAATTCTCCATCTCCTGGA
GTCAGCGACATTGTAGAAAGCGTGGCCGCTGTAGAGCTCGATGATAGCGACGGGGATGATGAACCTATGG
TACAAGTTGAAGCTGGTAAAGTAAATCATAGTGCTAGAAGCGATCTTTCTGACCTAAAGGTGGCTACCGAC
AATATCGTTAAAGATCTTAAGAAAATTATTACTAGAATCTCTGCAGTATCGACGGTTCTAGAGGATGTTCAAG
CAGCTGGTATCTCTAGACAATTTACTTCTATGACTAAAGCTATTACAACACTATCTGATCTAGTCACCGAGGG
AAAATCTAAAGTTGTTCGTAAAAAAGTTAAAACTTGTAAGAAGTAAATGCGTGCACTTTTTTATAAAGATGG
TAAACTCTTTACCGATAATAATTTTTTAAATCCTGTATCAGACGATAATCCAGCGTATGAGGTTTTGCAACATG
TTAAAATTCCTACTCATTTAACAGATGTAGTAGTATATGAACAAACGTGGGAGGAGGCGTTAACTAGATTAA
TTTTTGTGGGAAGCGATTCAAAAGGACGTAGACAATACTTTTACGGAAAAATGCATGTACAGAATCGCAAC
GCTAAAAGAGATCGTATTTTTGTTAGAGTATATAACGTTATGAAACGAATTAATTGTTTATAAACAAAAATA
TAAAGAAATCGTCCACAGATTCCAATTATCAGTTGGCGGTTTTTATGTTAATGGAAACTATGTTTTTTATTAG
ATTTGGTAAAATGAAATATCTTAAGGAGAATGAAACAGTAGGGTTATTAACACTAAAAAATAAACACATAGA
AATAAGTCCCGATGAAATAGTTATCAAGTTTGTAGGAAAGGACAAAGTTTCACATGAATTTGTTGTTCATAA
GTCTAATAGACTATATAAACCGCTATTGAAACTGACGGATGATTCTAGTCCCGAAGAATTTCTGTTCAACAAA
CTAAGTGAACGAAAGGTATACGAATGTATCAAACAGTTTGGTATTAGAATCAAGGATCTCCGAACGTATGG
AGTCAATTATACGTTTTTATATAATTTTTGGACAAATGTAAAGTCCATATCTCCTCTTCCATCACCAAAAAAGT
TAATAGCGTTAACTATCAAACAAACTGCTGAAGTGGTAGGTCATACTCCATCAATTTCAAAAAGAGCTTACA
TGGCAACGACTATTTTAGAAATGGTAAAGGATAAAAATTTTTTAGATGTAGTATCTAAAACTACGTTCGATG
AATTCCTATCTATAGTCGTAGATCACGTTAAATCATCTACGGATGGATGATATAGATCTTTACACAAATAATTAC
AAGACCGATAAATGGAAATGGATAAGCGTATGAAATCTCTCGCAATGACCGCTTTCTTTGGGGAGCTAAGC
ACATTAGATATTATGGCATTGATAATGTCTATATTTAAACGCCATCCAAACAATACCATTTTTTCAGTGGATAA
GGATGGTCAGTTTATGATTGATTTCGAATACGATAATTATAAGGCTTCTCAATATTTGGATCTGACCCTCACTC
CGATATTTGGAGATGAATGCAAGACTCACGCATCGAGTATAGCCGAACAATTGGCGTGTGCGGATATTATTA
AAGAGGATATTAGCGAATACATCAAAACTACTCCCCGTCTTAAACGATTTATAAAAAAATACCGCAATAGATC
AGATACTCGCATCAGTCGAGATACAGAAAAGCTTAAAATAGCTCTAGCTAAAGGCATAGATTACGAATATAT
AAAAGACGCTTGTTAATAAGTAAATGAAAAAAAACTAGTCGTTTATAATAAAACACAATATGGATGCCAACA
TAGTATCATCTTCTACTATTGCAACGTATATAGACGCTTTAGCGAAGAATGCTTCAGAATTAGAACAGAGGTC
TACCGCATACGAAATAAATAATGAATTGGAACTAGTATTTATTAAGCCGCCATTAATTACTTTGACAAATGTA
GTGAATATCTCTACGATTCAGGAATCGTTTATTCGATTTACCGTTACTAATAAGGAAGGTGTTAAAATTAGAA
CTAAGATTCCATTATCTAAGGTACATGGTCTAGATGTAAAAAATGTACAGTTAGTAGATGCTATAGATAACATA
GTTTGGGAAAAGAAATCATTAGTGACGGAAAATCGTCTTCACAAAGAATGCTTGTTGAGACTATCGACAG
AGGAACGTCATATATTTTTGGATTACAAGAAATATGGATCCTCTATCCGACTAGAATTAGTCAATCTTATTCAA
GCAAAAACAAAAAACTTTACGATAGACTTTAAGCTAAAATATTTTCTAGGATCCGGTGCCCAATCTAAAAGT
TCTTTGTTGCACGCTATTAATCATCCAAAGTCAAGGCCTAATACATCTCTGGAAATAGAATTCACACCTAGAG
ACAATGAAAAAGTTCCATATGATGAACTAATAAAGGAATTGACGACTCTATCACGTCATATATTTATGGCTTC

FIG.15AC

TCCAGAGAATGTAATTCTTTCTCCGCCTATTAACGCACCTATAAAGACTTTTATGTTGCCTAAACAAGATATA
GTAGGTCTGGATCTGGAAAATCTATATGCCGTAACTAAGACTGACGGCATTCCTATAACTATCAGAGTTACAT
CAAACGGGTTGTATTGTTATTTTACACATCTTGGTTATATTATTAGATATCCTGTTAAGAGAATAATAGATTCC
GAAGTAGTAGTCTTTGGTGAGGCAGTTAAGGATAAGAACTGGACCGTATATCTCATTAAGCTAATAGAGCC
TGTGAATGCAATCAATGATAGACTAGAAGAAAGTAAGTATGTTGAATCTAAACTAGTGGATATTTGTGATCG
GATAGTATTCAAGTCAAAGAAATATGAAGGTCCGTTTACTACAACTAGTGAAGTCGTCGATATGTTATCTACA
TATTTACCAAAGCAACCAGAAGGTGTTATTCTGTTCTATTCAAAGGGACCTAAATCTAACATTGATTTTAAAA
TTAAAAAGGAAAATACTATAGACCAAACTGCAAATGTAGTATTTAGGTACATGTCCAGTGAACCAATTATCTT
TGGAGAATCGTCTATCTTTGTAGAGTATAAGAAATTTAGCAACGATAAAGGCTTTCCTAAAGAATATGGTTC
TGGTAAGATTGTGTTATATAACGGCGTTAATTATCTAAATAATATCTATTGTTTGGAATATATTAATACACATAAT
GAAGTGGGTATTAAGTCCGTGGTTGTACCTATTAAGTTTATAGCAGAATTCTTAGTTAATGGAGAAATACTTA
AACCTAGAATTGATAAAACCATGAAATATATTAACTCAGAAGATTATTATGGAAATCAACATAATATCATAGTT
GAACATTTAAGAGATCAAAGCATCAAAATAGGAGATATCTTTAACGAGGATAAACTATCGGATGTGGGACA
TCAATACGCCAATAATGATAAATTTAGATTAAATCCAGAAGTTAGTTATTTTACGAATAAACGAACTAGAGGA
CCGTTGGGAATTTTATCAAACTACGTCAAGACTCTTCTTATTTCTATGTATTGTTCCAAAACATTTTTAGACG
ATTCCAACAAACGAAAGGTATTGGCGATTGATTTTGGAAACGGTGCTGACCTGGAAAAATACTTTTATGGA
GAGATTGCGTTATTGGTAGCGACGGATCCGGATGCTGATGCTATAGCTAGAGGAAATGAAAGATACAACAA
ATTAAACTCTGGAATTAAAACCAAGTACTACAAATTTGACTACATTCAGGAAACTATTCGATCCGATACATTT
GTCTCTAGTGTCAGAGAAGTATTCTATTTTGGAAAGTTTAATATCATCGACTGGCAGTTTGCTATCCATTATTC
TTTTCATCCGAGACATTATGCTACCGTCATGAATAACTTATCCGAACTAACTGCTTCTGGAGGCAAGGTATTA
ATCACTACCATGGACGGAGACAAATTATCAAAATTAACAGATAAAAAGACTTTTATAATTCATAAGAATTTAC
CTAGTAGCGAAAACTATATGTCTGTAGAAAAAATAGCTGATGATAGAATAGTGGTATATAATCCATCAACAAT
GTCTACTCCAATGACTGAATACATTATCAAAAAGAACGATATAGTCAGAGTGTTTAACGAATACGGATTTGT
TCTTGTAGATAACGTTGATTTCGCTACAATTATAGAACGAAGTAAAAAGTTTATTAATGGCGCATCTACAATG
GAAGATAGACCGTCTACAAAAAAACTTTTTCGAACTAAATAGAGGAGCCATTAAATGTGAAGGTTTAGATGT
CGAAGACTTACTTAGTTACTATGTTGTTTATGTCTTTTCTAAGCGGTAAATAATAATATGGTATGGGTTCTGAT
ATCCCCGTTCTAAATGCATTAAATAATTCCAATAGAGCGATTTTTTGTTCCTATAGGACCTTCCAACTGTGGATA
CTCTGTATTGTTAATAGATATATTAATACTTTTGTCGGGTAACAGAGGTTCTACGTCTTCTAAAAATAAAAGTT
TGATAACATCTGGCCTGTTCATAAATAAAAACTTGGCGATTCTATATATACTCTTATTATCAAATCTAGCCATTG
TCTTATAGATGTGAGCTACTGTAGGTGTACCATTTGATTTTCTTTCTAATACTATATATTTCTCTCGAAGAAGTT
CTTGCACATCATCTGGGAATAAAATACTACTGTTGAGTAAATCAGTTATTTTTTTTATATCGATATTGATGGAC
ATTTTTATAGTTAAGGATAATAAGTATCCCAAAGTAGATAACGACGATAACGAAGTATTTATACTTTTAGGAA
ATCACAATGACTTTATCAGATCAAAATTAACAAAATTAAAGGAGCATGTATTTTTTCTGAATATATTGTGACTC
CAGATAAATATGGATCTTTATGCGTCGAATTAAATGGGTCTAGTTTTCAGCACGGCGGTAGATATATAGAGG
TGGAGGAATTTATAGATGCTGGAAGACAAGTTAGATGGTGTTCTACATCCAATCATATATCTGAAGATATACC
CGAAGATATACACACTGATAAATTTGTCATTTATGATATATACACTTTTGACGCTTTCAAGAATAAACGATTGG
TATTCGTACAGGTACCTCCGTCGTTAGGAGATGATAGCTATTTGACTAATCCGTTATTGTCTCCGTATTATCGT
AATTCAGTAGCCAGACAAATGGTCAATGATATGATTTTTAATCAAGATTCATTTTTAAAATATTTATTAGAACA
TCTGATTAGAAGCCACTATAGAGTTTCTAAACATATAACAATAGTTAGATACAAGGATACCGAAGAATTAAAT
CTAACGAGAATATGTTATAATAGAGATAAGTTTAAGGCGTTTGTATTCGCTTGGTTTAACGGCGTTTCGGAA
AATGAAAAGGTACTAGATACGTATAAAAAGGTATCTAATTTGATATAATGAATTCAGTGACTGTATCACACGC
GCCATATACTATTACTTATCACGATGATTGGGAACCAGTAATGAGTCAATTGGTAGAGTTTTATAACGAAGTA
GCCAGTTGGCTGCTACGAGACGAGACGTCGCCTATTCCTGATAAGTTCTTTATACAGTTGAAACAACCGCT
TAGAAATAAACGAGTATGTGTGTGCGGTATAGATCCGTATCCGAAAGATGGAACTGGTGTACCGTTCGAATC

<div style="text-align:center">*FIG.15AD*</div>

```
ACCAAATTTTACAAAAAAATCAATTAAGGAGATAGCTTCATCTATATCTAGATTAACCGGAGTAATTGATTAT
AAAGGTTATAACCTTAATATAATAGACGGGGTTATACCCTGGAATTATTACTTAAGTTGTAAATTAGGAGAAA
CAAAAAGTCACGCGATCTACTGGGATAAGATTTCCAAGTTACTGCTGCAGCATATAACTAAACACGTTAGTG
TTCTTTATTGTTTGGGTAAAACAGATTTCTCGAATATACGGGCCAAGTTAGAATCCCCGGTAACTACCATAGT
CGGATATCATCCAGCGGCTAGAGACCGCCAATTCGAGAAAGATAGATCATTTGAAATTATCAACGTTTTACT
GGAATTAGACAACAAGGCACCTATAAATTGGGCTCAAGGGTTTATTTATTAATGCTTTAGTGAAATTTTAAC
TTGTGTTCTAAATGGATGCGGCTATTAGAGGTAATGATGTTATCTTTGTTCTTAAGACTATAGGTGTCCCGTC
AGCGTGCAGACAAAATGAAGATCCAAGATTTGTAGAAGCATTTAAATGCGACGAGTTAGAAAGATATATTG
AGAATAATCCAGAATGTACACTATTCGAAAGTCTTAGGGATGAGGAAGCATACTCTATAGTCAGAATTTTCA
TGGATGTAGATTTAGACGCGTGTCTAGACGAAATAGATTATTTAACGGCTATTCAAGATTTTATTATCGAGGT
GTCAAACTGTGTAGCTAGATTCGCGTTTACAGAATGCGGCGCCATTCATGAAAATGTAATAAAATCCATGAG
ATCTAATTTTTCATTGACTAAGTCTACAAATAGAGATAAAACAAGTTTTCATATTATCTTTTTAGACACGTATA
CCACTATGGATACATTGATAGCTATGAAACGAACACTATTAGAATTAAGTAGATCATCTGAAAATCCACTAAC
AAGATCGATAGACACTGCCGTATATAGGAGAAAAACAACTCTTCGGGTTGTAGGTACTAGGAAAAATCCAA
ATTGCGACACTATTCATGTAATGCAACCACCGCATGATAATATAGAAGATTACCTATTCACTTACGTGGATATG
AACAACAATAGTTATTACTTTTCTCTACAACAACGATTGGAGGATTTAGTTCCTGATAAGTTATGGGAACCA
GGGTTTATTTCATTCGAAGACGCTATAAAAAGAGTTTCAAAATATTCATTAATTCTATAATAAACTTTAATGAT
CTCGATGAAAATAATTTTACAACGGTACCACTGGTCATAGATTACGTAACACCTTGTGCATTATGTAAAAAAC
GATCGCATAAACATCCGCATCAACTATCGTTGGAAAATGGTGCTATTAGAATTTACAAAACTGGTAATCCAC
ATAGTTGTAAAGTTAAAATTGTTCCGTTAGATGGTAATAAACTGTTTAATATTGCACAAAGAATTTTAGACAC
TAACTCTGTTTTATTAACCGAACGAGGAGACCATATAGTTTGGATTAATAATTCATGGAAATTTAACAGCGA
AGAACCCTTGATAACAAAACTAATTTTGTCAATAAGACATCAACTACCTAAGGAATATTCAAGCGAATTACT
CTGTCCAAGAAAACGAAAGACTGTAGAAGCTAACATACGAGACATGTTAGTAGATTCAGTAGAGACCGATA
CCTATCCGGATAAACTTCCGTTTAAAAATGGTGTATTGGACCTGGTAGACGGAATGTTTTACTCTGGAGATG
ATGCTAAAAAATATACGTGTACTGTATCAACCGGATTTAAATTTGACGATACAAAGTTCGTCGAAGACAGTC
CAGAAATGGAAGAGTTAATGAATATCATTAACGATATCCAACCATTAACGGATGAAAATAAGAAAAATAGA
GAGCTATATGAAAAAACATTATCTAGTTGTTTATGTGGTGCTACCAAAGGATGTTTAACATTCTTTTTTGGAG
AAACTGCAACTGGAAAGTCGACAACCAAACGTTTGTTAAAGTCTGCTATCGGTGACCTGTTTGTTGAGAC
GGGTCAAACAATTTTAACAGATGTATTGGATAAAGGACCTAATCCATTTATCGCTAACATGCATTTGAAAAG
ATCTGTATTCTGTAGCGAACTACCTGATTTTGCCTGTAGTGGATCAAAGAAAATTAGATCTGACAATATTAAA
AAGTTGACAGAACCTTGTGTCATTGGAAGACCGTGTTTCTCCAATAAAATTAATAATAGAAACCATGCGACA
ATCATTATCGATACTAATTACAAACCTGTTTTTGATAGGATAGATAACGCATTAATGAGAAGAATTGCCGTCG
TGCGATTCAGAACACACTTTCTCAACCTTCTGGTAGAGAGGCTGCTGAAAATAATGACGCGTACGATAAAG
TCAAACTATTAGACGAGGGGTTAGATGGTAAAATACAAAATAATAGATATAGATTCGCATTTCTATACTTGTT
GGTGAAATGGTACAGAAAATATCATGTTCCTATTATGAAACTATATCCTACACCGGAAGAGATTCCGGACTT
TGCATTCTATCTCAAAATAGGTACTCTGTTAGTATCTAGCTCTGTAAAGCATATTCCATTAATGACGGACCTCT
CCAAAAAGGGATATATATTGTACGATAATGTGGTCACTCTTCCGTTGACTACTTTCCAACAGAAAATATCCAA
GTATTTTAATTCTAGACTATTTGGACACGATATAGAGAGCTTCATCAATAGACATAAGAAATTTGCCAATGTT
AGTGATGAATATCTGCAATATATATTCATAGAGGATATTTCATCTCCGTAAATATATGCTCATATATTTATAGAAG
ATATCACATATCTAAATGAATACCGGAATCATAGATTTATTTGATAATCATGTTGATAGTATACCAACTATATTAC
CTCATCAGTTAGCTACTCTAGATTATCTAGTTAGAACTATCATAGATGAGAACAGAAGCGTGTTATTGTTCCA
TATTATGGGATCAGGTAAAACAATAATCGCTTTGTTGTTCGCCTTGGTAGCTTCCAGATTTAAAAAGGTTTA
CATTCTAGTGCCTAATATCAACATTTTGAAAATTTTTAATTATAATATGGGTGTAGCTATGAACTTGTTTAATG
ACGAATTCATAGCTGAGAATATCTTTATTCATTCCACAACAAGTTTTTATTCTCTTAATTATAACGATAACGTC
```

<p style="text-align:center">*FIG.15AE*</p>

ATTAATTATAACGGATTATCTCGCTACAATAACTCTATTTTTATCGTTGATGAGGCACATAATATCTTTGGGAAT
AATACTGGAGAACTTATGACCGTGATAAAAAATAAAAACAAGATTCCTTTTCTACTATTGTCTGGATCTCCCA
TTACTAACACACCTAATACTCTGGGTCATATTATAGATTTAATGTCCGAAGAGACGATAGATTTTGGTGAGAT
TATTAGTCGTGGTAAGAAAGTAATTCAGACACTTCTTAACGAACGCGGTGTGAATGTACTTAAGGATTTGCT
TAAAGGAAGAATATCATATTACGAAATGCCTGATAAAGATCTACCAACGATAAGATATCACGGACGTAAGTT
TCTAGATACTAGAGTAGTATATTGTCACATGTCTAAACTTCAAGAGAGAGATTATATGATTACTAGACGACAG
CTATGTTATCATGAAATGTTTGATAAAAATATGTATAACGTGTCAATGGCAGTATTGGGACAACTTAATCTGAT
GAATAATTTAGATACTTTATTTCAGGAACAGGATAAGGAATTGTACCCAAATCTGAAAATAAATAATGGCGT
GTTATACGGAGAAGAATTGGTAACGTTAAACATTAGTTCCAAATTTAAATACTTTATTAATCGGATACAGACA
CTCAACGGAAAACATTTTATATACTTTTCTAATTCTACATATGGTGGATTGGTAATTAAATATATCATGCTCAGT
AATGGATATTCTGAATATAATGGTTCTCAGGGAACTAATCCACATATGATAAACGGCAAACCAAAAACATTT
GCTATCGTTACTAGTAAAATGAAATCGTCTTTAGAGGATCTATTAGATGTGTATAATTCTCCTGAAAACGATG
ATGGCAGTCAATTGATGTTTTTGTTTTCATCAAACATTATGTCCGAATCCTATACTCTAAAAGAGGTAAGGCA
TATTTGGTTTATGACTATCCCAGATACTTTTTCTCAATACAACCAAATTCTTGGACGATCTATTAGAAAATTCT
CTTACGCCGATATTTCTGAACCAGTTAATGTATATCTTTTAGCCGCCGTATATTCCGATTTCAATGACGAAGTA
ACGTCATTAAACGATTACACACAGGATGAATTGATTAATGTTTTACCATTTGACATCAAAAAGCTGTTGTATC
TAAAATTTAAGACGAAAGAAACGAATAGAATATACTCTATTCTTCAAGAGATGTCTGAAACGTATTCTCTTCC
ACCACATCCATCAATTGTAAAAGTTTTATTGGGAGAATTGGTCAGACAATTTTTTTATAATAATTCTCGTATTA
AGTATAACGACTCCAAGTTACTTAAAATGGTTACATCAGTTATAAAAAATAAAGAAGACGCTAGGAATTACA
TAGATGATATTGTAAACGGTCACTTCTTTGTATCGAATAAAGTATTTGATAAATCTCTTTTATACAAATACGAA
AACGATATTATTACAGTACCGTTTAGACTTTCCTACGAACCATTTGTTTGGGGAGTTAACTTTCGTAAAGAAT
ATAACGTGGTATCTTCTCCATAAAACTGATGAAATATATAAAGAAATAAATGTCGAGCTTTGTTACCAATGGA
TACCTTCCAGTTACATTGGAACCACACGAGCTGACGTTAGACATAAAAACTAATATTAGGAATGCCGTATATA
AGACGTATCTCCATAGAGAAATTAGTGGTAAAATGGCCAAGAAAATAGAAATTCGTGAAGACGTGGAATTA
CCTCTCGGCGAAATAGTTAATAATTCTGTAGTTATAAACGTTCCGTGTGTAATAACCTACGCGTATTATCACGT
TGGGGATATAGTCAGAGGAACATTAAACATCGAAGATGAATCAAATGTAACTATTCAATGTGGAGATTTAAT
CTGTAAACTAAGTAGAGATTCGGGTACTGTATCATTTAGCGATTCAAAGTACTGCTTTTTTCGAAATGGTAAT
GCGTATGACAATGGCAGCGAAGTCACTGCCGTTCTAATGGAGGCTCAACAAGGTATCGAATCTAGTTTTGT
TTTTCTCGCGAATATCGTCGACTCATAAAAAAGAGAATAGCGGTAAGTATAAACACGAATACTATGGCAATA
ATTGCGAATGTTTTATTCTCTTCGATATATTTTTGATAATATGAAAAACATGTCTCTCTCAAATCGGACAACCA
TCTCATAAAATAGTTCTCGCGCGCTGGAGAGGTAGTTGCTGCTCGTATAATCTCCCCAGAATAATATACTTGC
GTGTCGTCGTTCAATTTATACGGATTTCTATAGTTCTCTGTTATATAATGCGGTTTTCCATCATGATTAGACGA
CGACAATAGTGTTCTGAATTTAGATAGTTGATCAGAATGAATGTTTATTGGCGTTGGAAAAATTATCCATACA
GCGTCTGCAGAGTGGTTGATAGTTGTTCCTAGATATGTAAAATAATCCAACTTACTAGGCAGCAAATTGTCT
AGATAAAATACTGAATCAAACGGTGCAGACGTATTGGCGGATCTAATGGAATCCAATTGATTAACTATCTTT
TGAAAATATACATTTTTATGATCCAATACTTGTAAGAATATAGAAATAATGATAAGTCCATCATCGTGTTTTTTT
GCCTCTTCATAAGAACTATATTTTTTTTATTCCAATGAACAAGATTAATCTCTCCAGAGTATTTGTACACATCT
ATCAAGTGATTGGATCCATAATCGTCTTCCTTTCCCCAATATATATGTAGTGATGATAACACATATTCATTGGG
GAGAAACCCTCCACTTATATATCCTCCTTTAAAATTAATCCTTACTAGTTTTCCAGTGTTCTGGATAGTGGTTG
GTTTCGACTCATTATAATGTATGTCTAACGGCTTCAATCGCGCGTTAGAAATTGCTTTTTTAGTTTCTATATTA
ATAGGAGATAGTTGTTGCGGCATAGTAAAAATGAAATGATAACTGTTTAAAAATAGCTCTTAGTATGGGAAT
TACAATGGATGAGGAAGTGATATTTGAAACTCCTAGAGAATTAATATCTATTAAACGAATAAAAGATATTCCA
AGATCAAAAGACACGCATGTGTTTGCTGCGTGTATAACAAGTGACGGATATCCGTTAATAGGAGCTAGAAG
AACTTCATTCGCGTTCCAGGCGATATTATCTCAACAAAATTCAGATTCTATCTTTAGAGTATCCACTAAACTAT

*FIG.15AF*

```
TACGGTTTATGTACTACAATGAACTAAGAGAAATCTTTAGACGGTTGAGAAAAGGTTCTATCAACAATATCG
ATCCTCACTTTGAAGAGTTAATATTATTGGGTGGTAAACTAGATAAAAAGGAATCTATTAAAGATTGTTTAAG
AAGAGAATTAAAAGAGGAAAGTGATGAACGTATAACAGTAAAAGAATTTGGAAATGTAATTCTAAAACTTA
CAACACGGGATAAATTATTTAATAAAGTATATATAAGTTATTGCATGGCGTGTTTTATTAATCAATCGTTGGAG
GATTTATCGCATACTAGTATTTACAATGTAGAAATTAGAAAGATTAAATCATTAAATGATTGTATTAACGACGA
TAAATACGAATATCTGTCTTATATTTATAATATGCTAGTTAATAGTAAATGAACTTTTACAGATCTAGTATAATTA
GTCAGATTATTAAGTATAATAGACGACTAGCTAAGTCTATTATTTGCGAGGATGACTCTCAAATTATTACACTC
ACGGCATTCGTTAACCAATGCCTATGGTGTCATAAACGAGTATCCGTGTCCGCTATTTTATTAACTACTGATA
ACAAATATTAGTATGTAACAGACGAGATAGTTTTCTCTATTCTGAAATAATTAGAACTAGAAACATGTCTAG
AAAGAAACGATTATTTCTGAATTATTCCAATTATTTGTCCAAACAGGAAAGAAGTATACTATCGTCATTTTTT
TCTCTAGATCCAGCTACTACTGATAATGATAGAATAGATGCTATTTATCCGGGTGGCATACCCAAAAGGGGT
GAGAATGTTCCAGAGTGTTTATCCAGGGAAATTAAAGAAGAAGTTAATATAGACAATTCTTTTGTATTCATA
GACACTCGGTTTTTTATTCATGGCATCATAGAAGATACCATTATTAATAAATTTTTTGAGGTAATCTTCTTTGT
CGGAAGAATATCTTTAACGAGTGATCAAATCATTGATACATTTAAAAGTAATCATGAAATCAAGGATCTAATA
TTTTTAGATCCGAATTCAGGTAATGGACTCCAATACGAAATTGCAAAATATGCTCTAGATACTGCAAAACTCA
AATGTTATGGCCATAGAGGATGTTATTACGAATCATTAAAAAATTAACTGAGGATGATTGATTAGAAAATATA
AATTAATTTACCATCGTGTATTTTTATAACGGGATTGTCCGGCATATCATGTAGATAGTTACCGTCTACATCGT
ATACTCGACCATCTACGCCTTTAAATCCTCTATTTATTGACATTAATCTATTAGAATTGGAATACCAAATATTAG
TACCCTCAATTAGTTTATTGGTAATATTTTTTTTAGACGATAGATCGATGGCTCTTGAAACCAAGGTTTTCCA
ACCGGACTCATTGTCGATCGGTGAGAAGTCTTTTTCATTAGCATGAATCCATTCTAATGATGTATGTTTAAAC
ACTCTAAACAATTGGACAAATTCTTTTGATTTGCTTTGAATGATTTCAAATAGGTCTTCGTCTACAGTAGGCA
TACCATTAGATAATCTAGCCATTATAAAGTGCACGTTTACATATCTACGTTCTGGAGGAGTAAGAACGTGACT
ATTGAGACGAATGGCTCTTCCTACTATCTGACGAAGAGACGCCTCGTTCCATGTCATATCTAAAATGAAGAT
ATCATTAATTGAGAAAAAACTAATACCCTCGCCTCCACTAGAAGAGAATACGCATGTTTTAATGCATTCTCCG
TTAGTGTTTGATTCTTGGTTAAACTCAGCCACCGCCTTGATTCTAGTATCTTTTGTTCTAGATGAGAACTCTAT
ATTAGAGATACCAAAGACTTTGAAATATAGTAATAAGATTTCTATTCCTGACTGATTAACAAATGGTTCAAAG
ACTAGACATTTACCATGGGATGCTAATATTCCCAAACATACATCTATAAATTTGACGCTTTTCTCTTTTAATTC
AGTAAATAGAGAGATATCAGCCGCACTAGCATCCCCTTTCAATAGTTCTCCCTTTTTAAAGGTATCTAATGCG
GATTTAGAAAACTCTCTATCTCTTAATGAATTTTTAAAATCATTATATAGTGTTGCTATCTCTTGCGCGTATTCG
CCCGGATCACGATTTTGTCTTTCAGGAAAGCTATCGAACGTAAACGTAGTAGCCATACGTCTCAGAATTCTA
AATGATGATATACCTGTTTTTATTTCAGCGAGTTTAGCCTTTTGATAAATTTCTTCTTGCTTTTTCGACATATTA
ACGTATCGCATTAATACTGTTTTCTTAGCGAATGATGCAGACCCTTCTACGTCATCAAAAATAGAAAACTCGT
TATTAACTATGTACGAACATAGGCCTCCTAGTTTGGAGACTAATTCTTTCTCATCAACTAGACGTTTATTCTCA
AATAGCGATTGGTGTTGTAAGGATCCTGGTCGTAGTAAGTTAACCAACATGGTGAATTCTTGCACACTATTA
ACGATAGGTGTAGCCGATAAACAAATCATCTTATGGTTTTTTAATGCGATGGTCTTAGATAAAAATTATATACT
GAACGAGTAGGACGGATCTTACCATCTTCTTTGATTAATGATTTAGAAATGAAGTTATGACATTCATCAATAA
TGACGCATATTCTACTCTTGGAATTAATAGTTTTGATATTAGTAAAAAATTTATTTCTAAAATTTTGATCATCGT
AATTAATAAAATACAATCCTTCGTTATCTCTGGAGCGTATCTGAGTATAGTGTTCATCCAAGGATCTTCTATCA
AAGCCTTTTTCACCAATAAGATAATAGCCCAATTCGTATAAATATCCTTAAGATGTTTGAGAATATATACAGTA
GTCATTGTTTTACCGACACCCGTTTCATGGAACAATAAAAGAGAATGCATACTGTCTAATCCTAAGAAAACT
CTTGCTACAAAATGTTGATAATCCTTGAGGCGTACTACGTCCGACCCCATCATTTCAACGGGCATATTAGTAG
TTCTGCGCAATGCATAATCGATATAGGCCGCGTGTGATTTACTCATTTATGAGTGATAAGTAATAACTATGTTT
TAAAAATCACAGCAGTAGTTTAACTAGTCTTCTCTGATGTTTGTTTTCGATACTTTTTGAATCAGAAGTCATA
CTAGAATAAAGCAACGAGTGAACGTAATAGAGAGCTTCGTATACTCTATTCGAAAACTCTAAGAACTTATTA
```

<div align="center">

*FIG.15AG*

</div>

ATGAATTCCGTATCCACTGGATTGTTTAAAATACTAAATTGAACACTGTTCACATCCTTCCAAGAAGAAGACT
TAGTGACGGACTTAACATGAGACATAAATAAATCCAAATTTTTTTTACAAACATCACTAGCCACCATAATGGC
GCTATCTTTCAACCAGCTATCGCTTACGCATTTTAGCAGTCTAACATTTTTAAAGAGACTACAATATATTCTCA
TAGTATCGATTACACCTCTACCGAATAAAGTTGGAAGTTTAATAATACAATATTTTTCGTTTACAAAATCAAAT
AATGGTCGAAACACGTCGAAGGTTAACATCTTATAATCGCTAATGTATAGATTGTTTTCAGTGAGATGATTAT
TAGATTTAATAGCATCTCGTTCACGTTTGAACAGTTTATTGCGTGCGCTGAGGTCGGCAACTACGGCGTCCG
CTTTAGTACTCCTCCCATAATACTTTACGCTATTAATCTTTAAAATTTCATAGACTTTATCTAGATCGCTTTCTG
GTAACATGATATCATGTGTAAAAAGTTTTAACATGTCGGTCGGCATTCTATTTAGATCATTAACTCTAGAAATC
TGAAGAAAGTAATTAGCTCCGTATTCCAGACTAGGTAATGGGCTTTTACCTAGAGACAGATTAAGTTCTGG
CAATGTTTCATAAAATGGAAGAAGGACATGCGTTCCCTCCCGGATATTTTTTACAATTTCATCCATTTACAAC
TCTATAGTTTGTTTTCATTATTATTAGTTATTATCTCCCATAATCTTGGTAATACTTACCCCTTGATCGTAAGATA
CCTTATACAGGTCATTACATACAACTACCAATTGTTTTTGTACATAATAGATTGGATGGTTGACATCCATGGTG
GAATAAACTACTCGAACAGATAGTTTATCTTTCCCCTAGATACATTAGCCGTAATAGTTGTCGGCCTAAAGAA
TATCTTTGGTGTAAAGTTAAAAGTTAGGGTTCTTGTTCCATTATTGCTTTTTGTCAGTAGTTCATTATAAATTC
TCGAGATGGGTCCGTTCTCTGAATATAGAACATCATTTCCAAATCTAACTTCTAGTCTAGAAATAATATCGGT
CTTATTCTTAAAATCTATTCCCTTGATGAAGGGATCGTTAATGAACAAATCCTTGGCCTTTGATTCGGCTGAT
CTATTATCTCCGTTATAGACGTTACGTTGACTAGTCCAAAGACTTACAGGAATAGATGTATCGATGATGTTGA
TACTATGTGATATGTGAGCAAAGATTGTTCTCTTAGTGGCATCACTATATGTTCCAGTAATGGCGGAAAACTT
TTTAGAAATGTTATATATAAAAGAATTTTTTCGTGTTCCAAACATTAGCAGATTAGTATGAAGATAAACACTC
ATATTATCAGGAACATTATCAATTTTTACATACACATCAGCATCTTGAATAGAAACGATACCATCTTCTGGAAC
CTCAACAATCTCGGCAGACTCCGGATAACCAGTCGGTGGGCCATCACTAACAATAACTAGATCATCCAACA
ATCTACTCACATATGCATCTATATAATCTTTTTCATCTTGTGAGTACCCTGGATACGAAATAAATTTATTATCCGT
ATTTCCATAATAAGGTTTAGTATAAACAGAGAGCGATGTTGCCGCATGAACTTCAGTTACAGTCGCCGTTGG
TTGGTTTATTTGACCTATTACTCTCCTAGGTTTCTCTATAAACGATGGTTTAATTTGTACATTCTTAACCATATA
TCCAATAAAGCTCAATTCAGGAACATAAACAAATTCTTTGTTGAACGTTTCAAAGTCGAACGAAGAGTCAC
GAATAACGATATCGGATACTGGATTGAAGGTTACCGTTACGGTAATTTTTGAATCGGATAGTTTAAGACTGC
TGAATGTATCTTCCACATCAAACGGAGTTTTAATATAAACGTATACTGTAGATGGTTCTTTAATAGTGTCATTA
GGAGTTAGGCCAATAGAAATATCATTAAGTTCACTAGAATATCCAGAGTGTTTCAAAGCAATTGTATTATTGA
TACAATTATTATATAATTCTTCGCCCTCAATTTCCCAAATAACACCGTTACACGAAGAGATAGATACGTGATTA
ATACATTTATATCCAACATATGGTACGTAACCGAATCTTCCCATACCTTTAACTTCTGGAAGTTCCAAACTCAG
AACCAAATGATTAAGCGCAGTAATATACTGATCCCTAATTTCGAAGCTAGCGATAGCCTGATTGTCTGGACC
ATCGTTTGTCATAACTCCGGATAGAGAAATATATTGCGGCATATATAAAGTTGGAATTTGACTATCGACTGCG
AAGACATTAGACCGTTTAATAGAGTCATCCCCACCGATCAAAGAATTAATGATAGTATTATTCATTTTCTATTT
AAAATGGAAAAAGCTTACAATAAACTCCGTAGAGAAATATCTATAATTTGTGAGTTTTCCTTAAAGTAACAG
CTTCCGTAAACGCCGTCTTTATCTCTTAGTAAGTTTATTGTATTTATAACCTTTTCCTTATCTTCATAGAATACTA
AAGGCAACAAAGAAATTTTTGGTTCTTCTCTAAGAGCTACGTGAGACTTAACCATAGACGCCAACGAATCC
CTACATATTTTAGAACAGAAATACCCAACTTCACCACCCTTGAATGTCTCAATACTAATAGGTTTAAAAACCA
AATCTTGATTACAAAACCAACACTTATCAATTACACTATTTGTCTTAATAGACACATCTGCCATAGATTTATAAT
ACTTTGGTAGTATACAAGCGAGTGCTTCTTCTTTAGCGGGCTTAAAGACTGCTTTAGGTGCTGAAATAACC
ACATCTGGAAGGCTTACTCGCTTAGCCATTTAATTACGGAACTATTTTTTTATACTTCTAATGAGCAAGTAGA
AAACCTCTCATCTACAAAAACATACTCGTGTCCATAATCCTCTACCATAGTTACACGTTTTTTAGATCTCATAT
GTGCTAAAAAGTTTTCCCATACTAATTGGTTACTATTATTTTTCGTATAATTTTTAACAGTTTGAGGTTTTAGA
TTTTTAGTTACAGAAGTGATATCGAATATTTTATCCAAAAAGAATGAATAATTAATTGTCTTAGAAGGAGTGT
TTTCTTGGCAAAAGAATACCAAGTGCTTAAATATTTCTACTACTTCATTAATCTTTTCTGTACTCAGATTCAGT

*FIG.15AH*

TTCTCATCTTTTACTTGATTGATTATTTCAAAGACTAACTTATAATCCTTTTTATTTATTCTCTCGTTAGCCTTAA
GAAAACTAGATACAAAATTTGCATCTACATCATCCGTGGATATTTGATTTTTTTCCATGATATCCAAGAGTTCC
GAGATAATTTCTCCAGAACATTGATGAGACAATAATCTCCGCAATACATTTCTCAAATGAATAAGTTTATTAG
ACACATGGAAGTTTGACTTTTTTGTACCTTTGTACATTTTTGAAATACCGACTCGCAAAAAATACAATATTCA
TATCCTTGTTCAGATACTATACCGTTGTGTCTACAACCGCTACATAATCGTAGATTCATGTTAACACTCTACGT
ATCTCGTCGTCCAATATTTTATATAAAAACATTTTATTTCTAGACGTTGCCAGAAAATCCTGTAATATTTTTAGT
TTTTTGGGCTGTGAATAAAGTATCGCCCTAATATTGTTACCGTCTTCCGCCAATATAGTAGTTAAATTATCCGC
ACATGCAAAAGAACACCGCTTAGGCGGATTCAGTACAATGTTATATTTTTCGTACCAACTCATTTAAATATCA
TAATCTAAAATAGTTCTGTAATATGTCTAGCGCTAATATATTGATCATAATCCTGTGCATAAATTAAGATACAAC
AATGTCTCGAAATCATCGACATGGCTTCTTCCATAGTTAGAAGATCGTCGTCAAAGTTAGCAACGTGATTCA
TCAACATTTGCTGTTTTGAGGCAGCAAATACTGAACCGTCGCCATTCAACCATTCATAAAAACCATCGTCTG
AATCCATTGATAATTTCTTGTACTGGTTTTTGAGAGCTCGCATCAATCTAGCATTTCTAGCTCCCGGATTGAA
AACAGAAAGAGGATCGTACATCCAGGGTCCATTTTCTGTAAATAGAATCGTATAATGTCCCTTCAAGAAGAT
ATCAGACGATCCACAATCAAAGAATTGGTCTCCGAGTTTGTAACAAACTGCGGACTTTAACCTATACATGAT
ACCGTTTAGCATGATTTCTGGTGATACGTCAATCGGAGTATCATCTATTAGAGATCTAAAGCCGGTGTAACAT
TCTCCACCAAACATATTCTTATTCTGACGTCGTTCTACATAAAACATCATTGCTCCATTAACGATAACAGGGG
AATGAACAGCACTACCCATCACATTAGTTCCCAATGGATCAATGTGTGTAACTCCAGAACATCTTCCATATCC
TATGTTAGGAGGAGCGAACACCACTCTTCCACTATTGCCATCGAATGCCATAGAATAAATATCCTTGGAATT
GATAGAAATCGGACTGTCGGATGTTGTGATCATCTTCATAGGATTAACAACTATGTATGGTGCCGCCTGAAG
TTTCATATCGTAACTGATGCCGTTTATAGGTCTAGCCACAGAAACCAACGTAGGTCTAAATCCAACTATAGAC
AAAATAGAAGCCAATATCTGTTCCTCATCTGTCATAACTTGAGAGCATCCAGTATGAATAATCTTCATTAGAT
GGGGATCTACCGCATCATCATCGTTACAATAAAAAATTCCCATTCTAATGTTCATAATTGCTTTTCTAATCATG
GTATGCATGTTTGCTCTCTGAATCTCTGTGGAAATTAGATCTGATACACCTGTAATCACTATCGGATTATCCTC
CGTAAGACGATTAACCAACAACATATAATTATAAGACTTTACTTTTCTAAATTCATAAAGTTGCTGGATTAGG
CTATAGGTGTCTCCATGTACATACGCGTTCTCGAGCGCAGGAAGTTTAATACCGAATAGTGCCATCAGAATA
GGATGAATATAGTAATTAGTTTCTGGTTTTCTATAAATAAAAGACAAATCTTGTGAACTAGACATATCGGTAA
AATGCATGGATTGGAATCGTGTAGTCGACAGAAGAATATGATGATTAGATGGAGAGTATATTTTATCTAACTC
TTTGAGTTGGTCACCGATTCTAGGACTAGCTCGAGAATGAATAAGTACTAAAGGATGAGTACATTTCACAG
AAACACTAGCATTGTTCAATGTGCTCTTTACATGGGTAAGGAGTTGAAATAGCTCGTTTCTATTTGTTCTGAC
AATATTTAGTTTATTCATAATGTTAAGCATATCCTGAATAGTAAAGTTAGATGTGTCATACTTGTTAGTAGTTA
GATATTTAGCAATTGCATTCCATCATTTCTCAATCTCGTACTCCAATCATGTGTAGATGCTACTTCGTCGATG
GAAACCATACAATCCTTTTTTGATAGGCTGTTGAGATTGATTATTTCCTGCACGTTTAGGTTTGGTACGTTGAT
TTCTAGCCCTGCAGATATAAAGTCATCGTCTACAATTTTGGATAATGAATTGCATACACTACAAGACAAAGAT
TTATCAGAAGTGTGAATATGATCTTCATCTACCAAAGAAAGAGTTTGATTAGTATAACTAGATTTTAGTCCTG
CGTTAGATGTTAAAAAAACATCGCTATTGACCACGGCTTCCATTATTTATATTCGTAGTTTTTACTCGAAAGC
GTGATTTTAATATCCAATCTTATTACTTTTGGAATCGTTCAAAACCTTTGACTAGTTGTAGAATTTGATCTATT
GCCCTACGCGTATACTCCCTTGCATCATATACGTTCGTCACCAGATCGTTTGTTTCGGCCTGAAGTTGGTGCA
TATCTTTTTCAACACTCGACATGAGATCCTTAAGGGCCATATCGTCTAGATTTTGTTGAGATGCTGCTCCTGG
ATTTGGATTTTGTTGTGCTGTTGTACATACTGTACCACCAGTAGGTGTAGGAGTACATACAGTGGCCACAAT
AGGAGGTTGAGGAGGTGTAACCGTTGGAGTAGTACAAGAAATACTTCCATCCGATTGTTGTGTACATGTAG
TTGTTGGTAACGTCTGAGAAGGTTGGGTAGATGGCGGTGTCGTCGTCTTTTGATCTTTATTAAATTTAGAGA
TAATATCCTGAACAGCATTGCTCGGCGTCAACGCTGGAAGGAGTGAACTCGCCGGCGCATCAGTATCTGCA
GACAGCCAATCAAAAAGATTAGACATATCAGATGATGTATTAGTTTGTTGTCGTGGTTTTGGTGTAGGAGCA
GTACTACTAGGTAGAAGAATAGGAGCCGATGTAGGTGTCGGAACCGGAACCGGCTGTGGAGTTATATGAA

<div style="text-align:center">*FIG.15AI*</div>

TAGTTGGTTGTAGCGGTTGGATAGGCTGTCTGCTGGCGGCCATCATATTATCTCTAGCTAGTTGTTCTCGCA
ACTGTCTTTGATAATACGACTCTTGAGACTTTAGTCCTATTTCAATCGCTTCATCCTTTTTCGTATCCGGATCC
TTTTTTTCAGAATAATAGATTGACGACTTTGGTGTAGAGGATTCTGCCAGCCCCTGTGAGAACTTGTTAAAG
AAGTCCATTTAAGGCTTTAAAATTGAATTGCGATTATAAGATTAAATGGCAGACACAGACGATATTATCGAC
TATGAATCCGATGATCTCACTGAATACGAGGATGATGAAGAAGAGGAAGAAGATGGAGAGTCACTAGAAA
CTAGTGATATAGATCCCAAATCTTCTTATAAGATTGTAGAATCAGCATCCACTCATATAGAAGATGCGCATTCC
AATCTTAAACATATAGGGAATCATATATCTGCTCTTAAACGACGCTATACTAGACGTATAAGTCTATTTGAAAT
AGCGGGTATAATAGCAGAAAGCTATAACTTGCTTCAACGAGGAAGATTACCTCTAGTTTCAGAATTTTCTGA
CGAAACGATGAAGCAAAATATGCTACATGTAATTATACAAGAGATAGAGGAGGGTTCTTGTCCTATAGTCAT
CGAAAAGAACGGAGAATTGTTGTCGGTAAACGATTTTGACAAAGATGGTCTAAAATTCCATCTAGACTATA
TTATCAAAATTTGGAAACTTCAAAAACGATATTAGAATTTATACGAATATCGTTCTCTAAATGTCACAATCAA
GTCTCGCATGTTCAGCAATTTATTGTCGTACTTTATATCGTGTTCATTAACGATATCTTGCAAAATAGTAATGA
TTCTATCTTCCTTCGATAGATATTCTTCAGAGATTATTGTCTTATATTCTTTCTTGTTATCCGATATGAATTTGAT
AAGACTTTGAACATTATTAATACCCGTCTGTTTAATTTTTTCTACAGATATTTTAGTTTTGGCAGATTCTATCG
TATCTGTCAATAGACATCCAACATCGACATTCGACGTCAATTGTCTATAAATCAACGTATAAATTTTAGAAATA
ACATTAGCGAATTGTTGTGCATTGATGTCGTTATTCTGAAACAGTATGATTTTAGGTAGCATTTTCTTAACAA
AGAGAACGTATTTATTGTTACTCAGTTGAACAGATGATATATCCAGATTACTAACGCATCTGATTCCGTATACC
AAACTTTCAGAAGAAATGGTGTACAATTGTTTGTATTCATTCAATGTCTCCTTTTCAGAAATTAGTTTAGAGT
CGAATACTGCAATAATTTTCAAGAGATAGTTTTCATCAGATAAGATTTTATTTAGTGTAGATATGATAAAACTA
TTGTTTTGTTGGAGAACTTGATACGCCGCGTTCTCTGTAGTCGACGCTCTCAAATGGGAAACGATCTCCATT
ATTTTTTTGGAATCGGATACTATATCTTCGGTATCTTGACGCAGTCTAGTATACATAGAGTTAAGAGAGATTA
GAGTTTGTACATTAAGCAACATGTCTCTAAATGTGGCTACAAACTTTTCCTTTTTCACATCATCTAGTTTATTA
TATACCGATTTCACAACGGCACCAGATTTAAGGAACCAGAATGAAAAACTCTGATAACTACAATATTTCATC
ATAGTTACGATTTTATCATCTTCTATAGTTGGTGTAATAGCGCATACCTTTTTCTCCAAGACTGGAACCAACGT
CATAAAAATGTTTAAATCAAAATCCATATCAACATCTGATGCGCTAAGACCAGTCTCGCGTTCAAGATTATCT
TTACTAATGGTGACGAACTCATCGTATAGAACTCTAAGTTTGTCCATTATTTATTTACAGATTTAGTTGTTTAA
TTTATTTGTGCTCTTCCAGAGTTGGGATAGTATTTTTCTAACGTCGGTATTATATTATTAGGATCTACGTTCATA
TGTATCATAATATTAATCATCCACGTTTTGATAAATCTATCTTTAGCTTCTGAAATAACGTATTTAAACAAAGGA
GAAAAATATTTAGCTACGGCATCAGACGCAATAACATTTTTTGTAAATGTAACGTATTTAGACGACAGATCTT
CGTTAAAAAGTTTTCCATCTATGTAGAATCCATCGGTTGTTAACACCATTCCCGCGTCAGATTGAATAGGAG
TTTGAATAGTTTGTTTTGGAAATAGATCCTTCAATAACTTATAGTTGGGTGGGAAAAAATCGATTTTATCACT
AGACTCTTTCTTTTTTACTATCATTACCTCATGAACTATTTCTTGAATGAGTATATGTATTTTCTTTCCTATATCG
GACGCGTTCATTGGAAAATATACCATGTCGTTAACTATAAGAATATTTTTATCCTCGTTTACAAACTGAATAAT
ATCAGATGTAGTTCGTAAACGAACTATATCATCACCAGCACAACATCTAACTATATGATATCCACTAGTTTCCT
TTAGCCGTTTATTATCTTGTTCCATATTAGCAGTCATTCCATCATTTAAGAAGGCGTCAAAAATAATAGGGAG
AAATGACATTTTGGATTCTGTTACGACTTTACCAAAATTAAGGATATACGGACTTACTATCTTTTTCTCAACG
TCAATTTGATGAACACACGATGAAAATGTGCTTCTATGAGATTGATCATGTAGAAAACAACAAGGGATACA
ATATTTCCGCATATCATGAAATATATTAAGAAATCCCACCTTATTATATTTCCCCAAAGGATCCATGCACGTAAA
CATTATGCCGTTATCATTAATAAAGACTTCTTTCTCATCGGATCTGTAAAAGTTGTTACTGATTTTTTCATTCC
AGGATCTAGATAATTAATAATGATGGGTTTTCTATTCTTATTCTTTGTATTTTGGCATATCCTAGACCAGTAAA
CAGTTTCCACTTTGGTAAAATCAGCAGACTTTTGAACGCTATTAAACATGGCATTAATGGCAATAACTAAAA
ATGTAAAATATTTTTCTATGTTAGGAATATGGTTTTTCACTTTAATAGATATATGGTTTTTGGCCAAAATGATA
GATATTTTTTTATCCGAGGATAGTAAAATATTATTAGTCGCCGTCTCTATAAAAATGAAGCTAGTCTCGATATC
CAATTTTATTCTAGAATTGATAGGAGTCGCCAAATGTACCTTATACGTTATATCTCCCTTGATGCGTTCCATTT

*FIG.15AJ*

GTGTATCTATATCGGACACAAGATCTGTAAATAGTTTTACGTTATTAATCATCACGGTATCGCCGTCGCTAGAT
AACGCTAATGTACCATCCAAGTCCCAAATGGAGAGATTTAACTGTTCATCGTTTAGAATAAAATGATTACCG
GTCATATTAATAAAGTGTTCATCGTATCTAGATAACAACGACTTATAATTAATGTCCAAGTCTTGAACTCGCTG
AATGATCTTTTTTAACCCAGTTAGTTTTAGATTGGTACGAAATATATTGTTAAACTTTGATTCTATAGTAATGT
CCAAATCTAGTTGTGGAAATACTTCCATCAACATTGTTTCAAACTTGATAATATTATTATCTACATCTTCGTACG
ATCCAAATTCCGGAATAGATGTATCGCACGCTCTGGCCACCCAGATAACCAAAAAGTCACACGCTCCAGGA
TATACATTGTATAAAAAGCTATCGTTTTTTAGTAGGGTTTTTTTCTGCGTGTATACGAAGGGATTAAAAATAG
TATTATCAACGTAACTATATTCCAAATTATTCTTATGAGAATAGATAATAATATCGTCCTTAATATCTAACAAATT
TCCTAAATATCCCTTTAATTGAGTCATTCGAAGCGTCAATAGAATATGTCTCTTAACTATTTCCGGCTGTTGTA
TATTTAAATGACTTCGTAAAAAATAATATATGGGCGACTTCTCATCTATGTAATCATATGGAGTGAGATATAGG
GCTCGTTCTACCTCCTGCCCTTACCCACCTGTAATACCAATTGCGGACTTACTATATATCGCATATTTATATCGT
GGGGTAAAGTGAAAATCTACTACCGATGATGTAAGTCTTACAATGTTCGAACCAGTACCAGATCTTAATTTG
GAGGCCTCCGTAGAACTAGGGGAGGTAAATATAGATCAAACAACACCTATGATAAAGGAGAATAGCGGTT
TTATATCCCGCAGTAGACGTCTATTCGCCCATAGATCTAAGGATGATGAGAGAAAACTAGCACTACGATTCTT
TTTACAAAGACTTTATTTTTTAGATCATAGAGAGATTCATTATTTGTTCAGATGCGTTGACGCTGTAAAAGAC
GTCACTATTACCAAAAAAAATAACATTATCGTGGCGCCTTATATAGCACTTTTAACTATCGCATCAAAAGGAT
GCAAACTTACAGAAACAATGATTGAAGCATTCTTTCCAGAACTATATAATGAACATAGTAAGAAATTTAAAT
TCAACTCTCAAGTATCCATCATCCAAGAAAAACTCGGATACCAGTTTGGAAACTATCACGTTTATGATTTTGA
ACCGTATTACTCTACAGTAGCTCTGGCTATTCGAGATGAACATTCATCTGGCATTTTTAATATCCGTCAAGAG
AGTTATCTGGTAAGTTCATTATCTGAAATAACATATAGATTTTATCTAATTAATCTAAAATCTGATCTTGTTCAA
TGGAGTGCTAGTACGGGCGCTGTAATTAATCAAATGGTAAATACTGTATTGATTACAGTGTATGAAAAGTTA
CAACTGGTCATAGAAAATGATTCACAATTTACATGTTCATTGGCTGTGGAATCAAAACTTCCAATAAAATTAC
TTAAAGATAGAAATGAATTATTTACAAAATTCATTAACGAGTTAAAAAAGACCAGTTCATTCAAGATAAGCA
AACGCGATAAGGATACGCTACTAAAATATTTTACTTAGGACTGGAGTTAGAATTTATAGACGACTCATTTCGT
TTATCATTATTACTACCATCATTATTAGTATTCTTCTTGTTATCTTGTTCAGAAATATACAGCAATGCTATGCCTA
ATACTAAATACATTATCATGCTTGCAATGGCTCTAACAACGACGAACCAAAATGAATTTGGTCGTAGCTTTTG
TTCACAAAAATACATAAAGAAATGTCTACATAAATCTATGGCGCCATTGGCTACTTGAAATAGCGCCAGTCCT
CCTACAGATTTTAATATAGCTGTATAACATGACATTTATTCATCATCAAAAGAGACAGAGTCACCATCTGTCAT
ATTTAGATTTTTTTTCATGTGTTCAAAGTATCCTCTACTCATTTCATTATAATAGTTTATCATACTTAGAATTTTA
GGACGGATCAATGAGTAAGACTTGACTAGATCGTCAGTAGTAATTTGTGCATCGTCTATTCTGCATCCGCTT
CGTCGAATAATGTATAGCATCGCTTTGAGATTCTCCATAGCTATCAAGTCTTTATACAATGACATGGAAATATC
TGTGAATACTTTATACTTCTCCAACATCGATGCCTTAACATCATCGCCTACTTTAGCATTGAAAATACGTTCTA
TTGTGTAGATGGATGTAACAAGATTTTTAAACAACAATGCCATCTTACACGATGATTGCCTCAAGTCTCCAAT
CGTTTGTTTAGAACGATTAGCTACAGAGTCCAATGCTTGGCTGACTAGCATATTATTATCTTTAGAAATTGTA
TTCTTCAATGAGGCGTTTATCATATCTGTGATTTCGTTAGTCATATTACAGTCTGACTGGGTTGTAATGTTATC
CAACATATCACCTATGGATACGGTACACGTACCAGCATTTGTAATAATCCTATCTAAGATGTTGTATGGCATTG
CGCAGAAAATATCTTCTCCTGTAATATCTCCACTCTCGATAAATCTACTCAGATTATTCTTAAATGCCTTATTCT
CTGGAGAAAAGATATCAGTGTCCATCATTTCATTAATAGTATACGCAGAAAAGATACCACGAGTATCAATTCT
ATCCAAGATACTTATCGGTTCCGAGTCACAGATAATGGTTTCCTCTCCTTCGGGAGATCCTGCATAGAAATAT
CTAGGACAATAGTTTCTATACTGTCTGTAACTCTGATAATCTCTAAAGTCACTAACTGATACCATGAAATTGA
GAAGATCAAACGCTGAAGTAATTAATTTTTCTGCCTCGTTTTTACTACAACTAGTTTTCATCAATGTAGTGAC
GATGTATTGTTTAGTTACTTTTGGTCTAATACTGATGATAGAGATATTATTGCTTCCCATAATGGATCTTCTAGT
AGTCACCTTAAAGCCCATTGATGCGAATAGCAGATAGATAAAGTCTTGGTATGACTCCTTTCTAATATAGTAC
GGACTACCTTTGTCACCCAACTTTATACCCACATAAGCCATAACAACCTCTTTAATAGCCGTTTCATGAGGTT

*FIG.15AK*

```
TATCAGCCATGAGCCTGAGTAGTTGGAAGAATCTCATGAATCCCGTCTCAGAAAGTCCTATATGCATGATAG
ATTTATCTTTCCTGGGAAACTCTCGTATAGTCATAGATGAAATACTCTTCAAAGTTTCTGAAATAAGATTAGTA
ACAGTCTTACCTCCGACTACTCTGGGTAACAAACAAACTCTAATAGGTGTTTTCTCTGCGGAGATAATATCA
GAAAGGATAGAGCAATAAGTAGTATTATTGTGATTATAAAGACCGAATACATAACAGGTAGAATTTATAAAC
ATCATGTCCTGAAGGTTTTTAGACTTGTATTCCTCGTAATCCATACCGTCCCAAAACATGGATTTGGTAACTT
TGATAGCCGTAGATCTTTGTTCCTTCGCCAACAGGTTAAAGAAATTAATAAAGAATTTGTTGTTTCTATTTAT
GTCCACAAATTGCACGTTTGGAAGCGCCACGGTTACATTCACTGCAGCATTTTGAGGATCGCGAGTATGAA
GTACGATGTTATTGTTTACTGGTATATCTGGAAAGAAATCTACCAGTCTAGGAATAAGAGATTGATATCGCAT
AGAAATAGTAAAGTTTATAATCTCATCATCGAAGAGCATTTTGTTACCATTGTAATAAATATCCACTCTGTCAT
ATGTATAAATGAAGTACTGTTCAAACATGATGAGATGTTTATATGTTGGCATAGTAGTGAGATCGACGTTTGG
TAATGGCAATGTATTAAGATTAACTCCATAATGTCTAGCAGCATCTGCGATGTTATAAGCGTCGTCAAAGCGG
GGTCGATCTTGTATTGTTATATATTGTCTAACACCTATAAGATTATCAAAATCTTGTCTGCTTAATACACCGTTA
ACAATTTTTGCCTTGAATTCTTTTATTGGTGCATTAATAACATCCTTATAGAGGATGTTAAACAAATAAGTGTT
ATCAAAGTTAAGATCTGGATATTTCTTTTCTGCTAGAACATCCATTGAGTCGGAGCCATCTGGTTTAATATAA
CCACCGATAAATCTAGCTCTGTATTCTGTATCCGTCAATCTAATATTAAGAAGGTGTTGAGTGAAAGGTGGA
AGATCGTAAAAGCTGTGAGTATTAATGATAGGATTAGTTTCCGAACTAATGTTAATTGGGGTATTAATAATAT
CTATATTTCCAGCGTTAAGTGTAACATTAAACAGTTTTAATTCACGTGAAGTAGTATCAATTAAATAATTAATG
CCCAATTTGGATATAGCAGCCTGAAGCTCATCTTGTTTAGTTACGGATCCTAATGAGTTATTAAGCAATATATC
GAACGGATGAACGAAGGTTGTTTTGAGTTTGTCGCATACTTTGTAATCTAGACATAGATGCGGAAGAACG
GTAGAAACTATACGAAATAAATATTCAGAGTCCTCTAATTGATCAAGAGTAACTATTGACTTAATAGGCATCA
TTTATTTAGTATTAAATGACGACCGTACCAGTGACGGATATACAAAACGATTTAATTACAGAGTTTTCAGAA
GATAATTATCCATCTAACAAAAATTATGAAATAACTCTTCGTCAAATGTCTATTCTAACTCACGTTAACAACGT
GGTAGATAGAGAACATAATGCCGCCGTAGTGTCATCTCCAGAGGAAATATCCTCACAACTTAATGAAGATCT
ATTTCCAGATGATGATTCACCGGCCACTATTATCGAACGAGTACAACCTCATACTACTATTATTGACGATACTC
CACCTCCTACGTTTCGTAGAGAGTTATTAATATCGGAACAACGTCAACAACGAGAAAAAGATTTAATATTAC
AGTATCGAAAAATGCTGAAGCAATAATGGAATCTAGATCTATGATAACTTCTATGCCAACACAAACACCATCC
TTGGGAGTAGTTTATGATAAAGATAAAAGAATTCAGATGTTAGAGGATGAAGTGGTTAATCTTAGAAATCA
ACGATCTAATACAAATCATCTGATAATTTAGATAATTTTACCAAAATACTATTTGGTAAGACTCCGTATAAAT
CAACAGAAGTTAATAAGCGTATAGCCATCGTTAATTATGCAAATTTGAACGGGTCTCCCTTATCAGTCGAGG
ACTTGGATGTTTGTTCAGAGGATGAAATAGATAGAATCTATAAAACGATTAAACAATATCACGAAAGTAGAA
AACGAAAAATTATCGTCACTAACGTGATTATTATTGTCATAAATATTATCGAGCAAGCATTGCTAAAACTCGG
ATTTGAAGAAATCAAAGGACTGAGTACCGATATCACTTCAGAAATTATCGATGTGGAGATCGGAGATGACT
GCGATGCTGTAGCATCAAAACTAGGAATCGGTAACAGTCCGGTTCTTAATATTGTATTGTTTATACTCAAGAT
ATTCGTTAAACGAATTAAAATTATTTAATTTAATACATTCCCATATCCAGACAACAATCGTCTGGATTAATCTG
TTCCTGTCGTCTCATACCGGACGACATATTAATCTTTTTATTAGTGGGCATCTTTTTAGATGGTTTCTTTTTCC
CAGCATTAACTGAGTCGATACCTAGAAGATCGTGATTGATCTCTCCGACCATTCCACGAACTTCTAATTGGC
CGTCTCTGACGGTACCATAAACTATTTTACCAGCATTAGTAACAGCTTGGACAATCTGACCATCCATCGCATT
GTACGATGTAGTAGTAACTGTTGTTCTACGTTTAGGAGCACCAGAAGTATTTTTGGAGCCCTTGGAGGCTG
ATGTAGAAGAAGACGAGGATTTTGATTTTGGTTTACATGTAATACATTTTGAACTCTTTGATTTTGTATCACA
TGCGCCGGCAGTCACATCTGTTTGAGAATTAAGATTATTGTTGCCTCCTTTGACGGCTGCATCTCCACCGAT
TTGCGCTAGTAGATTTTTAAGCTGTGGTGTAATCTTATTAACTGTTTCGATATAATCATCGTAACTGCTTCTAA
CGGCTAAATTTTTTTATCCGCCATTTAGAAGCTAAAAATATTTTTATTTATGCAGAAGATTTAACTAGATTATA
CAATGAACTAATATGATCCTTTTCCAGATTATTTACAAACTTGGTATTTTTTGGTTCTGGAGGAGGCGAATTT
AAATTCGGACTTGGATTCAGATTTTGTAAGTTCTTGATCTTATTATACATCGAGTATAGGATGGCGACAGTAA
```

*FIG.15AL*

CTGCTACACAAATACCGATCAAAAGAAGAATACCAATCATTTATTGACAATAACTTCACTATTGATCAAGTAT
GCAATATATCATCTTTTCACTAAATAAGTAGTAATAATGATTCAACAATGTCGAGATATATGGACGATAATAAT
TTAGTTCATGGAAATATCGCTATGATTGGTGTGAATGACTCCGCTAACTCTGTGGGGTGCGCAGTGCTTTCC
CCACATAGAATAAATTAGCATTCCGACTGTGATAATAATACCAAGTATAAACGCCATAATACTCAATACTTTCC
ATGTACGAGTGGGACTGGTAGACTTACTAAAGTCAATAAAGGCGAAGATACACGAAAGAATCAAAAGAAT
GATTCCAGCGATTAGCACGCCGGAAAAATAATTTCCAATCATAAGCATCATGTCCATTTAACTAATAAAAATT
TTAAATCGCCGAATGAACAAAGTGGAATATAAACCATATAAAAACAATAGTTTGTACTGCAAAAATAATATCT
ATTTTTGTTTTCGAAGATATGGTAAAATTAAATAGTAGTACACAGCATGTTATAACTAACAGCAGCAACGGC
TCGTAATTACTTATCATTTACTAGACGAAAAGGTGGTGGGATATTTTCTTGCTCAAATAATACGAATATATCAC
CCATCCATTTTATGCGATGTTTATATACTCTAATCTTTAATAGATCTATAGACGACGGGTTTACCAACAATATAG
ATTTTATCGATTCATCTAATTTAAACCCTTCCTTAAACGTGAATGATCTATTATCTGGCATAACGATGACTCTAC
CTGATGAATCGGACAATGTACTGGGCCATGTAGAATAAATTATCAACGAATTATCGTCTACGAACATTTATAT
CATTTGTTTTAATTTTAGGACGCGAATAAATGGATATAAAATAGAAAATAACAGATATTACAACCAGTGTTAT
GGCCGCGCCCAACCAGGTAGGCAGTTTTATTTTATCTTTTACTACAGGTTCTCCTGGATGTACGTCACCAAC
GGCGGACGTAGTTCTAGTACAATTAGACGTAAGTTCCGCTTGGGAATTTTTTAACGCTAAAGAGTTAACGT
TAATCGTGCACCCAACGTATTTACATCTAGTTCTTTGAACATCTTGATTATAATATAACCATTTTCTATCTCTAG
ATTCGTCGGTGCACTCATGTAACCAACATACCCTAGGTCCTAAATATTTATCTCCGGAATTAGATTTTGGATA
ATTCGCGCACCAACAATTTCTATTTCCTTTATGATCGTTACAAAAGACGTATAATGCCGTATCCCCAAAAGTA
AAATAATCAGGACGAATAATTCTAATAAACTCAGAACAATATCTCGCATCCATATGTTTGGAGCAAATATCGG
AATAAGTAGACATAGCCGGTTTCCGTTTTGCACGTAACCATTCTAAACAATTGGGGTTTCCAGGATCGTTTC
TACAAAATCCAGTCATGAAATCGTCACAATGTTCTGTCTTGTAATTATTATTAAATATTTTTGGACAGTGTTTG
GTATTTGTCTTAGAACAACATTTTGCTACGCTATCACTATCGCCCAGGAGATAATCCTTTTTTATAAAATGACA
TCGTTGCCCGGATGCTATATAATCAGTAGCGTGTTTTAAATCCTTAATATATTCAGGAGTTACCTCGTTCTGAT
AATAGATTAATGATCCAGGACGAAATTTGAAAGAACTACATGGTTCTCCATGAATTAATACATATTGTTTAGC
AAATTCAGGAACTATAAAACTACTACAATGATCTATCGACATACCATCTATCAAACAAAACTTGGGTTTAATT
TCTCCCGGAGATGTTTCATAATAGTACGTATAACTTTCTTCTGCAAACTTAACAGCTCTATTATATTCAGGATA
ATTAAAACCTAATTCCATATATTTGTCTCGTATATCTGCTATTCCTGGTGCTATTTTGATTCTATTAAGAGTAAC
AGCTGCCCCATTCTTAATAATCGTCAGTATTTAAACTGTTAAATGTTGGTATATCAACATCTACCTTATTTCCCG
CAGTATAAGGTTTGTTGCAGGTATACTGTTCAGGAATGGTTACATTTATACTTCTTCTATAGTCCTGTCTTTCG
ATGTTCATCACATATGCAAAGAACAGAATAAACAAAATAATGTAAGAAATAATATTAAATATCTGTGAATTCG
TAAATACATTGATTGCCATAATAATTACAGCAGCTACAATACACACAATAGACATTCCCACAGTGTTGCCATT
ACCTCCACGATACATTTGAGTTACTAAGCAATAGGTAATAACTAAGCTAGTAAGAGGCAATAGAAAAGATG
AGATAAATATCATCAATATAGAGATTAGAGGAGGGCTATATAGAGCCAAGACGAACAAAATCAAACCGAGT
AACGTTCTAACATCATTATTTTTGAAGATTCCCAAATAATCATTCATTCCTCCATAATCGTTTTGCATCATACCT
CCATCTTTAGGCATAAACGATTGCTGCTGTTCCTCTGTAAATAAATCTTTATCAAGCACTCCAGCACCCGCAG
AGAAGTCGTCAAGCATATTGTAATATCTTAAATAACTCATTTATATATTAAAAAATGTCACTATTAAAGATGGA
GTATAATCTTTATGCCGAACTAAAAAAAATGACTTGTGGTCAACCCCTAAGTCTTTTTAACGAAGACGGGG
ATTTCGTAGAAGTTGAACCGGGATCATCCTTTAAGTTTCTGATACCTAAGGGATTTTACGCCTCTCCTTCCGT
AAAGACGAGTCTAGTATTCGAGACATTAACAACGACCGATAATAAATCACTAGTATCAATCCAACAAATGC
GCCAAAGTTATATCCTCTTCAACGCAAAGTCGTATCTGAAGTAGTTTCTAATATGAGGAAAATGATCGAATC
AAAACGTCCTCTATACATTACTCTTCACTTGGCGTGTGGATTTGGTAAGACTATTACCACGTGTTATCTTATG
GCTACACACGGTAGAAAAACCGTCATTTGCGTACCCAATAAAATGTTAATACATCAATGGAAGACACAGGT
AGAGGCAGTCGGATTGGAACATAAGATATCCATAGATGGAGTAAGTAGTCTATTAAAGGAACTAAAGACTC
AAAGTCCGGATGTATTAATAGTAGTCAGTAGACATCTGACAAACGATGCCTTTTGTAAATATATCAATAAGCA

<div style="text-align:center">

*FIG.15AM*

</div>

```
TTATGATTTGTTCATCTTGGATGAATCACATACGTATAATCTGATGAACAATACAGCAGTTACAAGATTTTTAG
CGTATTATCCTCCGATGATGTGTTATTTTTTAACTGCTACACCTAGACCATCTAACAGAATTTATTGTAACAGT
ATTATTAATATTGCCAAGTTATCCGATCTAAAAAAAACTATCTATGCGGTAGATAGTTTTTTTGAGCCATATTC
CACAGACAATATTAGACATATGATAAAACGATTAGATGGACCATCTAATAAATATCATATATATACTGAGAAGT
TATTATCTGTAGACGAGCCTAGAAATCAACTTATTCTTGATACCCTGGTAGAAGAATTCAAGTCAGGAACTAT
TAATCGCATTTTAGTTATTACTAAACTACGTGAACATATGGTATTCTTCTACAAACGATTATTAGATCTTTTCGG
ACCAGAGGTTGTATTTATAGGAGACGCCCAAAATAGACGTACTCCAGATATGGTCAAATCAATCAAGGAAC
TAAATAGATTTATATTCGTATCCACCTTATTTTATTCCGGTACTGGTTTAGATATTCCTAGTTTGGATTCGTTGT
TCATTTGCTCGGCAGTAATCAACAATATGCAAATAGAGCAATTACTAGGGAGGGTATGTCGAGAAACAGAA
CTATTAGATAGGACGGTATATGTATTTCCTAACACATCCATCAAAGAAATAAAGTACATGATAGGAAATTTCA
TGCAACGAATTATTAGTCTGTCTGTAGATAAACTAGGATTTAAACAAAAAAGTTATCGGAAACATCAAGAAT
CCGATCCCACTTCTGTATGTACAACATCCTCCAGAGAAGAACGTGTATTAAATAGAATATTTAACTCGCAAAA
TCGTTAAGAAGTTTAAGCGACGATCCGCATGCTGCGCAGGCCAGTGTATTACCCCTCATAGTATTAATATAAT
CCAATGATACTTTTGTGATGTCGGAAATCTTAACCAATTTAGACTGACAGGCAGAACACGTCATGCAATCAT
CATCGTCATCGATAACTGTAGTCTTGGGCTTCTTTTTGCGGCTCTTCATTCCGGAACGCACATTGGTGCTATC
CATTTAGGTAGTAAAAAATAAGTCAGAATATGCCCTATAGCACGATCGTGCAAAACCTGGTATATCGTCTCTA
TCTTTATCACAATATAGTGTATCGACATCTTTATTATTATTGACCTCGTTTATCTTGGAACATGGAATGGGAAC
ATTTTTGTTATCAACGGCCATCTTTGCCTTAATTCCAGATGTTGTAAAATTATAACTAAACAGTCTATCATCGA
CACAAATGAAATTCTTGTTTAGACGTTTGTAGTTTACGTATGCGGCTCGTTCGCGTCTCATTTTTTCAGATAT
TGCAGGTACTATAATATTAAAAATAAGAATGAAATAACATAGGATTAAAAATAAAGTTATCATGACTTCTAGC
GCTGATTTAACTAACTTAAAAGAATTACTTAGTCTGTACAAAAGTTTGAGATTTTCAGATTCTGCGGCTATAG
AAAAGTATAATTCTTTGGTAGAATGGGGAACATCTACTTACTGGAAAATAGGCGTGCAAAAGGTAGCTAAT
GTCGAGACGTCAATATCTGATTATTATGATGAGGTAAAAAATAAACCGTTTAATATTGATCCGGGCTATTACA
TTTTCTTACCGGTATATTTTGGGAGCGTCTTTATTTATTCGAAGGGTAAAAATATGGTAGAACTTGGATCTGG
AAACTCTTTTCAAATACCAGATGATATGCGAAGTGCGTGTAACAAAGTATTAGACAGCGATAACGGAATAG
ACTTTCTGAGATTTGTTTTGTTAAACAATAGATGGATAATGGAAGATGCTATATCAAAATATCAGTCTCCAGT
TAATATATTTAAACTAGCTAGTGAGTACGGATTAAACATACCCAAATATTTAGAAATTGAAATAGAGGAAGAC
ACATTATTTGACGACGAGTTATACTCTATTATAGAACGCTCTTTCGATGATAAATTTCCAAAAATATCCATATC
GTATATTAAGTTGGGAGAACTTAGGCGGCAAGTTGTAGACTTTTTCAAATTCTCGTTCATGTATATTGAGTC
CATCAAGGTAGATCGTATAGGAGATAATATTTTTATTCCTAGCGTTATAACAAAATCAGGAAAAAGATATTA
GTAAAAGATGTAGACCATTTAATACGATCCAAGGTTAGAGAACATACATTTGTAAAAGTAAAAAAGAAAAA
CACATTTTCCATTTTATACGACTATGATGGAAACGGAACAGAAACTAGAGGAGAAGTAATAAAACGAATTAT
AGACACTATAGGACGAGACTATTATGTTAACGGAAAGTATTTCTCTAAGGTTGGTAGTGCAGGCTTAAAGC
AATTGACTAATAAATTAGATATTAATGAGTGCGCAACTGTCGATGAGTTAGTTGATGAGATTAATAAATCCGG
AACTGTAAAACGAAAAATAAAAAACCAATCAGCATTTGATTTAAGCAGAGAATGTTTGGGATATCCAGAAG
CGGATTTTATAACGTTAGTTAATAACATGCGGTTCAAAATAGAAAATTGTAAGGTTGTAAATTTCAATATTGA
AAATACTAATTGTTTAAATAACCCGAGTATTGAAACTATATATGGAAACTTTAACCAGTTCGTCTCAATCTTTA
ATATCGTCACCGATGTCAAAAAAGATTATTCGAGTGAAATAATATGCGCCTTTGATATAGGTGCAAAAAATCC
TGCCAGAACTGTTTTAGAAGTCAAGGATAACTCCGTTAGGGTATTGGATATATCAAAATTAGACTGGAGTTC
TGATTGGGAAAGGCGCATAGCTAAAGATTTGTCACAATATGAATACACTACAGTTCTTCTAGAACGTCAGCC
TAGAAGGTCGCCGTATGTTAAATTTATCTATTTTATTAAAGGCTTTTTATATCATACATCGGCTGCCAAAGTTA
TTTGCGTCTCGCCTGTCATGTCTGGTAATTCATATAGAGATCGAAAAAAGAGATCGGTCGAAGCATTTCTTG
ATTGGATGGACACATTCGGATTGCGAGACTCCGTTCCGGATAGACGCAAATTAGACGATGTAGCGGATAGT
TTCAATTTGGCTATGAGATACGTATTAGATAAATGGAATACTAATTATACACCTTATAATAGGTGTAAATCTAG
```

*FIG.15AN*

AAATTACATAAAAAAAATGTAATAACGTTAGTAACGCCATTATGGATAATCTATTTACCTTTCTACATGAAATA
GAAGATAGATATGCCAGAACTATTTTTAACTTTCATCTAATAAGTTGCGATGAAATAGGAGATATATATGGTC
TTATGAAAGAACGCATTTCCTCAGAGGATATGTTTGATAATATAGTGTATAATAAAGATATACATCCTGCCATT
AAGAAACTAGTGTATTGCGACATCCAACTTACTAAACACATTATTAATCAGAATACGTATCCGGTATTTAACG
ATTCTTCACAAGTGAAATGTTGTCATTATTTCGACATAAACTCAGATAATAGCAATATTAGCTCTCGTACAGTA
GAGATATTTGAGAGGGAAAAGTCATCTCTTGTATCATATATTAAAACTACCAATAAGAAGAGAAAGGTCAAT
TACGGCGAAATAAAGAAAACTGTTCATGGAGGCACTAATGCAAATTACTTTTCCGGTAAAAAGTCTGACGA
GTATCTGAGTACTACAGTTAGATCCAACATTAATCAACCTTGGATCAAAACCATCTCTAAGAGGATGAGAGT
TGATATCATTAATCACTCTATAGTAACGCGTGGAAAAAGCTCTATATTACAAACTATAGAAATTATTTTTACTA
ATAGAACATGTGTGAAAATATTCAAGGATTCTACTATGCACATTATTCTATCCAAGGACAAGGATGAAAAGG
GGTGTATACACATGATTGACAAATTATTCTATGTCTATTATAATTTATTTCTGTTGTTCGAGGATATCATCCAAA
ACGAGTACTTTAAAGAAGTAGCTAATGTTGTAAACCACGTACTCACGGCTACGGCATTAGATGAGAAATTAT
TCCTAATTAAGAAAATGGCTGAACACGATGTTTATGGAGTTAGCAATTTCAAAATAGGGATGTTTAACCTGA
CATTTATTAAGTCGTTGGATCATACCGTTTTCCCCTCTCTGTTAGATGAGGATAGCAAAATAAAGTTTTTTAA
GGGGAAAAAGCTCAATATTGTAGCATTACGATCTCTGGAGGATTGTATAAATTACGTGACTAAATCCGAGAA
TATGATAGAAATGATGAAGGAAAGATCGACTATTTTAAATAGCATAGATATAGAAACGGAATCGGTAGATCG
TCTAAAAGAATTGCTTCTAAAATGAAAAAAAACACTGATTCAGAAATGGATCAACGACTCGGATATAAGTTT
TTGGTGCCTGATCCTAAAGCCGGAGTTTTTTATAGACCGTTACATTTCCAATATGTATCGTATTCTAATTTTAT
ATTGCATCGATTGCATGAAATCTTGACCGTCAAGCGGCCACTCTTATCGTTTAAGAATAATACAGAACGAAT
TATGATAGAAATTAGCAATGTTAAAGTGACTCCTCCAGATTACTCACCTATAATCGCGAGTATTAAAGGTAAG
AGTTATGACGCATTAGCCACGTTCACTGTAAATATCTTTAAAGAGGTAATGACCAAAGAGGGTATATCCATC
ACTAAAATAAGTAGTTATGAGGGAAAAGATTCTCATTTGATAAAAATTCCGCTACTAATAGGATACGGGAAT
AAAAATCCACTTGATACAGCCAAGTATCTTGTTCCTAATGTCATAGGTGGAGTCTTTATCAATAAACAATCTG
TCGAAAAAGTAGGAATTAATCTAGTAGAAAAGATTACAACATGGCCAAAATTTAGGGTTGTTAAGCCAAAC
TCATTCACTTTCTCGTTTTCCTCCGTATCCCCTCCTAATGTATTACCGACAAGATATCGCCATTACAAGATATCT
CTGGATATATCACAATTGGAAGCGTTGAATATATCATCGACAAAGACATTTATAACGGTCAATATTGTTTTGC
TGTCTCAATATTTATCTAGAGTGAGTCTAGAATTCATTAGACGTAGTTTATCATACGATATGCCTCCAGAAGTT
GTCTATCTAGTAAACGCGATAATAGATAGTGCTAAACGAATTACTGAATCTATTACTGACTTTAATATTGATAC
ATACATTAATGACCTGGTGGAAGCTGAACACATTAAACAAAAATCTCAGTTAACGATTAACGAGTTCAAATA
TGAAATGCTGCATAACTTTTTACCTCATATGAACTATACACCCGATCAACTAAAGGGATTTTATATGATATCTT
TACTAAGAAAGTTTCTCTACTGTATCTTCCACACTTCTAGATATCCAGATAGAGATTCGATGGTTTGTCATCGC
ATCCTAACGTACGGCAAATATTTTGAGACGTTGGCACATGATGAATTAGAGAATTACATAGGCAACATCCGA
AACGATATCATGAACAATCACAAGAACAGAGGCACTTACGCGGTAAACATTCATGTACTAACAACTCCCGG
ACTTAATCACGCGTTTTCTAGCTTATTGAGTGGAAAGTTCAAAAAGTCAGACGGTAGTTATCGAACACATCC
TCACTATTCATGGATGCAGAATATTTCTATTCCTAGGAGTGTTGGATTTTATCCGGATCAAGTAAAGATTTCA
AAGATGTTTTCTGTCAGAAAATACCATCCAAGTCAATATCTTTACTTTTGTTCATCAGACGTTCCGGAAAGA
GGTCCTCAGGTAGGTTTAGTATCTCAATTGTCTGTCTTGAGTTCCATTACAAATATACTAACGTCTGAGTATTT
GGATTTGGAAAAGAAAATTTGTGAGTATATCAGATCATATTATAAAGATGATATAAGTTACTTTGAAACAGG
ATTTCCAATCACTATAGAAAATGCTCTAGTCGCATCTCTTAATCCAAATATGATATGTGATTTTGTAACTGACT
TTAGACGTAGAAAACGGATGGGATTCTTCGGTAACTTGGAGGTAGGTATTACTTTAGTTAGGGATCACATG
AATGAAATTCGCATTAATATTGGAGCGGGAAGATTAGTCAGACCATTCTTGGTTGTGGATAACGGAGAGCT
CATGATGGATGTGTGTCCGGAGTTAGAAAGCAGATTAGACGACATGACATTCTCTGACATTCAGAAAGAGT
TTCCGCATGTCATCGAAATGGTAGATATAGAACAATTTACTTTTAGTAACGTATGTGAATCGGTTCAAAAATT
TAGAATGATGTCAAAGGATGAAAGAAAGCAATACGATTTATGTGACTTTCCTGCCGAATTTAGAGATGGAT

<p style="text-align:center">FIG.15AO</p>

```
ATGTGGCATCTTCATTAGTGGGAATCAATCACAATTCTGGACCCAGAGCTATTCTTGGATGTGCTCAAGCTA
AACAAGCTATCTCTTGTCTGAGTTCGGATATACGAAATAAAATAGACAATGGAATTCATTTGATGTATCCAGA
GAGGCCAATCGTGATTAGTAAGGCTTTAGAAACTTCAAAGATTGCGGCTAATTGCTTCGGCCAACATGTTA
CTATAGCATTAATGTCGTACAAAGGTATCAATCAAGAGGATGGAATTATCATCAAAAAACAATTTATTCAGAG
AGGCGGTCTCGATATAGTTACCGCAAAGAAACATCAAGTAGAAATTCCATTGGAAAACTTTAATAACAAAG
AAAGAGATAGGTCTAACGCCTATTCAAAATTAGAAAGTAATGGATTAGTTAGACTGAATGCTTTCTTGGAAT
CCGGAGACGCTATGGCACGAAATATCTCATCAAGAACTCTTGAAGATGATTTTGCTAGAGATAATCAGATTA
GCTTCGATGTTTCCGAGAAATATACCGATATGTACAAATCTCGCGTTGAACGAGTACAAGTAGAACTTACTG
ACAAAGTTAAGGTACGAGTATTAACCATGAAAGAAAGAAGACCCATTCTAGGAGACAAATTTACCACTAGA
ACGAGTCAAAAGGGAACAGTCGCGTATGTCGCGGATGAAACGGAACTTCCATACGACGAAATGGTATCA
CGCCAGATGTCATTATTAATTCTACATCCATCTTCTCTAGAAAAACTATATCTATGTTGATAGAAGTTATTTTAA
CAGCCGCATATTCTGCTAAGCCGTACAACAATAAGGGAGAAAACCGACCTGTCTGTTTTCCTAGTAGTAAC
GAAACATCCATCGATACATATATGCAATTCGCTAAACAATGTTATGAGCATTCAAATCCGAAATTGTCTGATG
AAGAATTATCGGATAAAATCTTTTGTGAAAAGATTCTCTATGATCCTGAAACGGATAAGCCTTATGCATCCAA
AGTATTTTTTGGACCAATTTATTACTTGCGTCTGAGACATTTAACTCAGGACAAGGCAACCGTTAGATGTAG
AGGTAAAAAGACGAAGCTCATTAGACAGGCGAATGAGGGACGAAAACGTGGAGGAGGTATCAAGTTCG
GAGAAATGGAGAGAGACTGTTTAATAGCGCATGGCGCAGCCAATACTATTACAGAAGTTTTGAAAGATTC
GGAAGAAGATTATCAAGATGTGTATGTTTGTGAAAATTGTGGAGACATAGCAGCACAAATCAAGGGTATTA
ATACATGTCTTAGATGTTCAAAACTTAATCTCTCTCCTCTCTTAACAAAAATTGATACCACGCACGTATCTAAA
GTATTTCTTACTCAAATGAACGCCAGAGGCGTAAAAGTCAAATTAGATTTCGAACGAAGACCTCCTTCGTTT
TATAAACCATTAGATAAAGTTGATCTCAAGCCGTCTTTTCTGGTGTAATATTCTAGTTTGGTAGTAGATACATA
TCAATATCATCAAATTCGAGATCCGAATTATAAAATGGGCGTGGATTGTTAACTATAGAATCGGACGTCTGAT
ATTCGAAAATCTGTGGAGTTTCAGGTTTTGGTGGAGGTGTAACTGCTACTTGGGATACTGAAGTCTGATAT
TCAGAAAGCTGTGGATGTTCTGGTTCGGCATCCACCGATGGTGTCACATCACTAATCGGTTCGGTAACGTCT
GTGGATGGAGGTGCTACTTCTACAGAACCTGTAGCCTCAGTTGTCAACGGAGATACATTTTTAATGCGAGA
AAATGTATAATTTGGTAATGGTTTCTCATGTGGATCTGAAGAAGAGGTAAGATATCTACTAGAAAGATACCG
ATCACGTTCTAGTTCTCTTTTGTAGAACTTAACTTTTTCTTTCTCCGCATCTAGTTGATATTCCAACCTCTTCA
CGTTACTACGTTCAGATTCCAATTCACGTTCGCATGGGTTACCTCCGCAGTTTTTACGAGCGATTTCACGTT
CAGCCTTCATGCGTCTCTCCCTCTCTATCGAGTTTATCAGAGCAGTCTTTCTGAAGGCGATCGAACTCCAT
AAATTTCTCCAACGCTTTGATTGTTTCCATAGATTTCCGAACTTCAGCTTCTAGGACGGCGATTCTTTTTCTT
TCGAATTCACAGCTGGATGTACAACCGTTTCCATTACCGCCATCTCTAAGTTTCTTTTCTAGATCGGCAACAT
TTCATCCCCATGCCTTTTACATTCCTCGAGTCTACTGTCGTCGAAATATCGTTCCAGCTCCTTTTCGACATCAA
TAACTTTAGCACGTTGTCTCTCAAGCTCTCTTTTGTAGTTATCTGATTCCCTGGCACGTTTAAGATCTTCATGC
AATTGAGTCAGCTCTTAACTTCCTCTCTTGCTTCTTCGTCATAGTACGCGCAATCACTGTGAGATCCATTGTT
ACCACGTCTACACTCGGCGAGCTCGCGTTTAAGAGATTCAATTTCCCGTTTGTATTGGTCCATGTTTCCATT
GCTACCACCATTAGATTTACAGGCTGCTAGTTGTCGTTCGAGATCAGAAATACGGGTTTTCTTGGAATTGAT
TTCGTCGATGTACTTGGCATCGAAACACTTATTAAGTTCTTTTTCCAATTCTACGATTTTATTTCTTTCGCGAG
TCAATTCCCTCCTGTAGTAACTATCTGTTTTGTCAGATTCACGCTCTCTACGTAGACTTTCTTGCAAGTTACTA
ATTTGTTCCCTAGCACGTCCGAGTTTAGTTTTATATGCTGAATAGAGTTCTGATTCATCCTTTGAGCAGATCT
CTAGCGATCGTTTAAGATTCCTGATTCTAGTCTTTAGCCTATTTACCTCCTCAGAAGATGTTCCGTTACCGTT
GCGTTTACACTCGTTAAGCTGTCTATCAAGATCCATGATTCTATCTCTAAGACGTTGCATCTCTCTTTCCATAT
CAGCATTGCTTTCATTATTACGTCTGCAGTCACTCAACTGTCTTTCAATATCTGAGATTCTATCTCTAAGACGT
CGCATCTCTCTCTGTTTCAGCATTGGTTTCATTATTACGTCTACAGTCGTTCAACTGTCTTTCAAGATCTGATA
TTCTAGATTGGAGTCTGCTAATCTCTGTAGCATTTTCACGGCATTCACTCAGTTGTCTTTCAAGATCTGAAAT
```

*FIG.15AP*

```
TTTAGATTGGAGTCTGCTAATCTCTGTAAGATTTCCTCCTCCGCTCTCGATGCAGTTGGTCAACTTATTCTCTA
GTTCTCTAATACGCGAACGCAGTGCATCAACTTCTTGCGTGTCTTCCTGGTTGCGTGTACATTCATCGAGTC
TAGATTCGAGATCTCTAACGCGTCGTCGTTCTTCCTCAAGTTCTCTGCGTACTACAGAAAGCGTGTCCCTATC
TTGTTGATATTTAGCAATTTCTGATTCTAGAGTACTGATTTTGCTTACGTAGTTACTAATAGTTGTCTTGGCCT
TATCAAGATCCTCCTTGTATTTGTCGCATTCCTTGATATCCCTACGAAGTCTGGACAGTTCCCATTCGACATTA
CGACGTTTATCGATTTCAGCTCGGAGATCGTCATCGCGTTGTTTTAGCCACATACGACTGAGTTCAAGTTCT
CGTTGACAAGATCCATCTACTTTTCCATTCCTAATAGTATCCAGTTCCTTTTCTAGTTCTGAACGCATTTCTCG
TTCCCTATCAAGCGATTCTCTCAATTCTCGGATAGTCTTCTTATCAATTTCTAATAAATCTGAACCATCATCTGT
CCCATTTTGAATATCCCTGTGTTCTTTGATCTCTTTTGTAAGTCGGTCGATTCTTTCGGTTTTATAAACAGAAT
CCCTTTCCAAAGTCCTAATCTTACTGAGTTTATCACTAAGTTCTGCATTCAATTCGGTGAGTTTTCTCTTGGC
TTCTTCCAACTCTGTTTTAAACTCTCCACTATTTCCGCATTCTTCCTCGCATTTATCTAACCATTCAATTAGTTT
ATTAATAACTAGTTGGTAATCAGCGATTCCTATAGCCGTTCTTGTAATTGTGGGAACATAATTAGGATCTTCTA
ATGGATTGTATGGCTTGATAGCATCATCTTTATCATTATTAGGGGATGGACAACCTTAATTGGTTGGTCCTCA
TCTCCTCCAGTAGCGTGTGGTTCTTCAATACCAGTGTTAGTAATAGGCTTAGGCAAATGCTTGTCGTACGCG
GGCACTTCCTCATCCATCAAGTATTTATAATCGGGTTCTACTTCAGAATATTCTTTTCTAAGAGACGCGACTT
CGGGAGTTAGTAGAAGAACTCTGTTTCTGTATCTATCAACGCTGGAATCAATACTCAAGTTAAGGATAGCGA
ATACCTCATCGTCATCATCCGTATCTTCTGAAACACCATCATATGACATTTCATGAAGTCTAACGTATTGATAA
ATAGAATCAGATTTAGTATTAAACAGATCCTTAACCTTTTTAGTAAACGCATATGTATATTTTAGATCTCCAGA
TTTCATAATATGATCACATGCCTTAAATGTCAGTGCTTCCATGATATAATCTGGAACACTAATGGGTGACGAA
AAAGATACAGCACCATATGCTACGTTGATAAATAAATCTGAACCACTAAGTAGATAATGATTAATGTTAAGGA
AAAGAAAATATTCAGTGTATAGGTATGTCTTGGCGTCATATCTTGTACTAAACACGCTAAACAGTTTGTTAAT
GTGATCAATTTCCAATAGATTAATTAGAGCAGCGGGAATACCAACAAACATATTACCACATCCGTATTTTCTA
TGAATATCACATATCATGTTAAAAAATCTTAATAGAAGAGCGAATATCTCGTCTGACTTAATGAGACGTAGTT
CAGCAGCAACATAAGTCATAACTGTAAATAGAACATACTTTCCTGTAGTGTTGATTCTAGACTCCACATCAAC
ACCATTATTAAAAATAGTTTTATATACATCTTTAATCTGCTCTCCGTTAATCGTCGAACGTTCTAGTATACGGAA
ACACTTTGATTTCTTATCTGTAGTTAATGACTTAGTGATATCACGAAGAATATTACGAATTACATTTCTTGTTT
TTCTTGAGAGACCTGATTCAGAACTCAACTCATCGTTCCATAGTTTTTCTACCTCAGTGGCGAAATCTTTGG
AGTGCTTGGTACATTTTTCAATAAGGTTCGTGACCTCCATTTATTATAAAAAATTTATTCAAAACTTAACTACA
ATCGGGTAATTATAAGATCGTAAATCTCCCATGTGGCGGAATACTACCATCTATCGCATGTGGATGGACAGTA
GGTAATGGCCATGGGAACAGTAATGATTGCATATTTATCTTTCTTGCTAGTATTACTGCATATTGTCCCAATGT
TTCGATGTGATGTTCTAACCTATCAACTGCCGCTGTATCACAACAATAGTGTCCGATGAAATTAAGATTATGA
TCCAATGTGTTTAATATATGATTATCAAGTCTTATACGATCCGCGTCTTTTTGACAGGATCAGGTTCTTCTACA
GGAAGAAGTTTCGGCCTCTTATGATATTCATGTCTGGGAAACGGTGGTCTAGGGTGAGGCTCCGGTATCG
GAGTGGGTTTTGGATTATAATCATCATCGTCTATGACATCATCATCATCTTCGACTTCGATATTTATTTTGCTAT
CTTGATGATGTCCTGTATCAGTTGCATTTTCAGCACTCGACTGAATATTAGCGCATTCATTGTCTATTATTACC
ATATTTCTAAACCCAAAATGTATGTGTTGAACATCAGTACTATCGTTGATGAGTCTTATAGCATGAATTCGCTT
ATCGTTATCGGGTTTATCTTCTGTCACCTTAGCAATTCCTTTTTTATTAAACTCTACATAATCATATCCATTTCTA
TTGTTTGTTCTAATATAAACGAGTATAGCATCATTGCTAAATTTTTCAATAGTATCGAAAACAGAATATCCTAA
ACCATATAATATATATTCAGGGACACTCAAACTAAATGTCCAGGATTCTCCTAAATACGTAAACTTTAATAGTG
CGAAATCATTCAAAAATCTACCACTTATAGATAGATAGTACATAAATGCGTATAGTAGTCTACCTATCTCTTTAT
TATGAAAACCGGCATTACGATCATATATGTCGTGATATACCTGTGATCCGTTTACGTTAAACCATAAATACATG
GGTGATCCTATAAACATGAATTTATTTCTAATTCTCAGAGCTATAGTTAATTGACCGTGTAATATTTGCTTACAT
GCATACTTGATACGCTCATTAATAAAATTTTTATCATTGCTCGTTATCTCAGAATCGTATATATAAGGAGTACCA
TCGTGATTCTTACCAGATATTATACAAAATACTATATATAAAATATATTGACCAACGTTAGTAATCATATAAATGT
```

<p style="text-align:center">*FIG.15AQ*</p>

TTAACGTTTTAAATTTTGTATTCAATGATCCATTATCATACGCTAGCATGGTCTTATGATATTCATTCTTTAAAAT
ATAATATTGTGTTAGCCATTGCATTGGGGCTCCTAATGGAGATTTTTTATTCTCATCCATTTTAGGATAGGCTT
TCATAAAGTCCCTAATAACTTCGTGAATAATGTTTCTATGTTTTCTACTGATGCATGTATTTGCTTCGATTTTTT
TATCCCATGTTTCATCTATCATAGATTTAAACGCAGTAATGCTCGCAACATTAACATCTTGAACCGTTGGTACA
ATTCCGTTCCATAAATTTATAATGTTCGCCATTTATATAACTCATTTTTTGAATATACTTTTAATTAACAAAAGA
GTTAAGTTACTCATATGGGCGCCGTCCAGTCTGAACATCAATCTTTTTAGCCAGAGATATCATAGCCGCTCTT
AGAGTTTCAGCGTGATTTTCCAACCTAAATAGAACTTCATCGTTGCGTTTACAACACTTTTCTATTTGTTCAA
ACTTTGTTGTTACATTAGTAATCTTTTTTTCCAAATTAGTTAGCCGTTGTTGAGAGTTTCCTCATTGTCGTCT
TCATCGGCTTTAACAATTGCTTCGCGTTTAGCCTCTGGCTTTTTAGCAGCCTTTGTAGAAAAAATTCAGTT
GCTGGAATTGCAAGATCGTCATCTCCGGGGAAAAGAGTTCCGTCCATTTAAAGTACAGATTTTAGAAACTG
ACACTCTGCGTTATTTATATTTGGTACAACACATGGATTATAAATATCGATGTTAATAACATCAGAAAATGTAA
AGTCTATACATTGTTGCATCGTGTTAAATTTTCTAATGGATCTAGTATTATTGGGTCCAACTTCTGCCTGAAAT
CCAAATATGGAAGCGGATACAAAACCGTTTCCTGGATAAACCACACATCTCCACTTTTGCTTTACATCAGAA
ATTGTGTCGTTGACATCTTGAACTCTCCTATCTAATGCCGGTGTTCCACCTATAGATTTTGAATATTCGAATGC
TGCATGAGTAGCATTAAATTCCTTAATATTGCCATAATTTTCATATATTGAGTAACCCTGGATAAAAAGTAAAC
ACACCGCAGCCGTCGCTACCACAATAAAAAAAATTGATAGAGAGTTCATTTATAATCTATTAGAAGCTGACA
AAATTTTTTTACACGCATCAGACAATGCTTTAATAAATAGTTCAACATCTACTTTTGTCATATCGAACCGATG
GTATGATTCTAACCTAGAATTACATCCGAAAAAGTTGACTATGTTCATAGTCATTAAGTCATTAACAAACAAC
ATTCCAGACTCTGGATTATAAGACGATACTGTTTCGTCACAATTACCTACCTTAATCATGTGATTATGAATATT
GGCTATTAGAGCACCTTCTAAGAAATCTATAATATCTTTGAAACACGATTTAAAATCAAACCACGAATATACT
TCTACGAAGAAAGTTAGTTTACCCATAGGAGAAATAACTATAAATGGAGATCTAAATACAAAATCCGGATCT
ATGATAGTTTTAACATTATTATATTCTCTATTAAATACCTCCACATCTAAAAATGTTAATTTTGAAACTATGTCTT
CGTTTATTACCGTACCTGAACTAAACGCTATAAGCTCTATTGTTTGAGAACTCTTTAAACGATATTCTTGAAAT
ACATGTAACAAAGTTTCCTTTAACTCGGTCGGTTTATCTACCATAGTTACAGAATTTGTATCCTTATCTATAATA
TAATAATCAAAATCGTATAAAGTTATATAATTATCGCGTTCAGATTGGGATCTTTTCAAATAGACTAAAAACCC
CATTTCTCTAGTAAGTATCTTATGTATATGTTTGTAAAATATCTTCATGGTGGGAATATGCTCTACCGCAGTTAG
CCATTCCTCATTGACAGCGGTAGATGTATTAGACAAAACTATTCCAATGTTTAACAAGGGCCATTTTACGAG
ATTATTAAATCCTTGTTTGATAAATGTAGCCAATGAGGGTTCGAGTTCAACGACGATTGAATTCTCTTCCCGC
GGATGCTGCATGATGAACGACGGGATGTTGTTCGATTGATTTGGAATTCTTTTTCGACTTTTTGTTTATATTA
AATATTTTAAAATTTATAGCGGATAGCAATTCATGTACCACGGATAATGTAGACGCGTATTGCGCATCGATATC
TTTATTATTAGATAAATTTATCAATAAATGTGAGAAGTTTGCCTCGTTAAGGTCTTCCATTTAAATATTATATAA
ACATTTGTGTTTGTATCTTATTCGTCTTTTATGGAATAGTTTTTTACTAGTAAAGCTGCAATTACACACTTTGT
CCGTAAAACATAAATATAAACACCAGCTTTTATCAATCGTTCCAAAAAGTCGACGGCGGACATTTTTAACAT
GGCATCTATTTTAAATACACTTAGGTTTTTGGAAAAAACATCATTTTATAATTGTAACGATTCAATAACTAAA
GAAAAGATTAAGATTAAACATAAGGGAATGTCATTTGTATTTTATAAGCCAAAGCATTCTACCGTTGTTAAAT
ACTTGTCTGGAGGAGGTATATATCATGATGATTTGGTTGTATTGGGGAAGGTAACAATTAATGATCTAAAGA
TGATGCTATTTTACATGGATTTATCATATCATGGAGTGACAAGTAGTGGAGCAATTTACAAATTGGGATCGTC
TATCGATAGACTTTCTCTAAATAGGACTATTGTTACAAAAGTTAATAATTATGATGATACATTTTTTGACGACG
ATGATTGATCGCTATTGCACAATTTTGTTTTTTTACTTTCTAATATAGCGTTTAGATTCTTTTTCATGTGCGAAT
ATTGATTTACTAAAATATCGATGTTTAACTTTTGTTCTATGACGTCCTTATCAGCGGTATCGGTACATATACGTA
ATTCACCTTCACAAAATACGGAGTCTTCGATAATAATAGCCAATCGATTATTGGATCTAGCGGTCTGTATCATA
TTCAACATGTTTAATATATCCTTTCGTTTCCCCTTTACAGGCATCGATCGTAGCATATTTTCCGCGTCTGAGAT
GGAAATGTTAAAACTACAAAAATGCGTAATGTTAGCCCGTCCTAATATTGGTACGTGTCTATAAGTTTGGCAT
AGTAGAATAATAGACGTGTTTAAATGCCTTCCAAAGTTTAAGAATTCTATTAGAGTATTGCATTTTGATAGTT

*FIG.15AR*

TATCGCCTACATCATCAAAAATAAGTAAAAAGTGTGCTGATTTTTTATGATTTTGTGCGACAGCAATACATTT
TTCTATGTTACTTTTAGTTCGTATCAGATTATATTCTAGAGATTCCTGACTACTAACGAAATTAATATGATTTGG
CCAAATGTATCCATCATAATCTGGATTATAAACGGGTGTAAACAAGAATATATGTTTATATTTTTAACTAGTGT
AGAAAACAGAGATAGTAAATAGATAGTTTTTCCAGATCCAGATCCTCCCGTTAAAACCATTCTAAACGGCAT
TTTTAATAAATTTTCTCTTGAAAATTGTTTTTCTTGGAAACAATTCATAATTATATTTACAGTTACTAAATTAAT
TTGATAATAAATCAAAATATGGAAAACTAAGGTCGTTAGTAGGGAGGAGAACAAAGAAGGCACATCGTGA
CATAAATAACATTTATTATCATGATGACACCAGAAAACGACGAAGAGCAGACATCGTGTTCTCCGCTACTG
TTTACAGAGACAAAATTCAGGGAAAGAATAAACGCAAACGCGTGATTGGTCTATGTATTAGAATATCTATGG
TTATTTCACTACTATCTATGATTACCATGTCCGCGTTTCTCATAGTGCGCCTAAATCAATGCATGTCTGCTAAC
GAGGCTGCTATTACTGACGCCGCTGTTGCCGTTGCTGCTGCATCATCTACTCATAGAAAGGTTGCGTCTAGC
ACTACGCAATATGATCACAAAGAAAGCTGTAATGGTTTATATTACCAGGGTTCTTGTTATATATTACATTCAGA
CTACCAGTTATTCTCGGATGCTAAAGCAAATTGCACTGCGGAATCATCAACACTACCCAATAAATCCGATGTC
TTGACTACCTGGCTCATTGATTATGTTAAGGATACATGGGGATCTGATGGTAATCCAATTACAAAAACTACAT
CCGATTATCAAGATTCTGATGTATCACAAGAAGTTAGAAAGTATTTTTGTGTTAAAACAATGAACTAATATTT
ATTTTTGTACATTAATAAATGAAATCGCTTAATAGACAAACTGTAAGTAGGTTTAAGAAGTTGTCGGTGCCG
GCCGCTATAATGATGATACTCTCAACCATTATTAGTGGCATAGGAACATTTCTGCATTACAAAGAAGAACTG
ATGCCTAGTGCTTGCGCCAATGGATGGATACAATACGATAAACATTGTTATTTAGATACTAACATTAAAATGT
CTACAGATAATGCGGTTTATCAGTGTCGTAAATTACGAGCCAGATTGCCTAGACCGGATACTAGACATCTGA
GAGTATTGTTTAGTATTTTTTATAAAGATTATTGGGTAAGTTTAAAAAAGACCAATGATAAATGGTTAGATAT
TAATAATGATAAAGATATAGATATTAGTAAATTAACAAATTTTAAACAACTAAACAGTACGACGGATGCTGAA
GCGTGTTATATATACAAGTCTGGAAAACTGGTTAAAACAGTATGTAAAAGTACTCAATCTGTACTATGTGTTA
AAAAATTCTACAAGTGACAACAAAAAATGAATTAATAATAAGTCGTTAACGTACGCCGCCATGGACGCCGC
GTTTGTTATTACTCCAATGGGTGTGTTGACTATAACAGATACATTGTATGATGATCTCGATATCTCAATCATGG
ACTTTATAGGACCATACATTATAGGTAACATAAAAACTGTCCAAATAGATGTACGGGATATAAAATATTCCGA
CATGCAAAAATGCTACTTTAGCTATAAGGGTAAAATAGTTCCTCAGGATTCTAATGATTTGGCTAGATTCAAC
ATTTATAGCATTTGTGCCGCATACAGATCAAAAAATACCATCATCATAGCATGCGACTATGATATCATGTTAGA
TATAGAAGATAAACATCAGCCATTTTATCTATTCCCATCTATTGATGTTTTTAACGCTACAATCATAGAAGCGT
ATAACCTGTATACAGCTGGAGATTATCATCTAATCATCAATCCTTCAGATAATCTGAAAATGAAATTGTCGTTT
AATTCTTCATTCTGCATATCAGACGGCAATGGATGGATCATAATTGATGGGAAATGCAATAGTAATTTTTTAT
CATAAAAGTTGTAAAGTAAATAATAAAACAATAAATATTGAACTAGTAGTACGTATATTGAGCAATCAGAAAT
GATGCTGGTACCTCTTATCACGGTGACCGTAGTTGCGGGAACAATATTAGTATGTTATATATTATATATTTGTA
GGAAAAAGATACGTACTGTCTATAATGACAATAAAATTATCATGACAAAATTAAAAAAGATAAAGAGTTCTA
ATTCCAGCAAATCTAGTAAATCAACTGATAGCGAATCAGACTGGGAGGATCACTGTAGTGCTATGGAACAA
AACAATGACGTAGATAATATTTCTAGGAATGAGATATTGGACGATGATAGCTTCGCTGGTAGTTTAATATGG
GATAACGAATCCAATGTTATGGCGCCTAGCACAGAACACATTTACGATAGTGTTGCTGGAAGCACGCTGCT
AATAAATAATGATCGTAATGAACAGACTATTTATCAGAACACTACAGTAGTACTTAATGAAGATACCAAACAG
AATCCTAACTATTCATCCAATCCTTTCGTAAATTATAATAAAACCAGTATTTGTAGCAAGTCAAATCCGTTCAT
TACAGAACTCAACAATAAATTTAGTGAGAATAATCCGTTTAGACGAGCACATAGCGATGATTATCTTAATAAG
CAAGAACAAGATCATGAACACGATGATATAGAATCATTGGTGTGATTAGTTTCCTTTTTATAAAATTGAAGTA
ATATTTAGTATTATTGCTGCCGTCACGTTGTACAAATGGAGATATTCCCTGTATTCGGCATTTCTAAAATTAGC
AATTTTATTGCTAATAATGACTGTAGATATTATATAGATACAGAACATCAAAAAATTATATCTGATGAGATCAAT
AGACAGATGGATGAAACGGTACTTCTTACCAACATCTTAAGCGTAGAAGTTGTAAATGACAATGAGATGTA
CCATCTTATTCCTCATAGATTATCGACGATTATACTCTGTATTAGTTCTGTCGGAGGATGTGTTATCTCTATAGA
TAATGACGTCAATGGCAAAAATATTCTAACCTTTCCCATTGATCATGCTGTAATCATATCCCCACTGAGTAAAT

GTGTCGTAGTTAGCAAGGGTCCTACAACCATATTGGTTGTTAAAGCGGATATACCTAGCAAACGATTGGTAA
CATCGTTTACAAACGACATACTGTATGTAAACAATCTATCACTGATTAATTATTTGCCGTTGTCTGTATTCATTA
TTAGACGAGTTACCGACTATTTGGATAGACACATATGCGATCAGATATTTGCGAATAATAAGTGGTATTCCAT
TATAACCATCGACAATAAGCAGTTTCCTATTCCATCAAACTGTATAGGTATGTCCTCTGCCAAGTACATAAATT
CTAGCATCGAGCAAGATACTTTAATACATGTTTGTAACCTCGAGCATCCATTCGACTTAGTATACAAAAAAAT
GCAGTCGTACAATTCTGTACCTATCAAGGAACAAATATTGTACGGTAGAATTGATAATATAAATATGAGCATT
AGTATTTCTGTGGATTAATAGATTTCTAGTATGGGGATCATTAATCATCTCTAATCTCTAAATACCTCATAAAAC
GAAAAAAAAGCTATTATCAAATACTGTACGGAATGGATTCATTCTCTTCTCTTTTTATGAAACTCTGTTGTATA
TCTACTGATAAAACTGGAAGCAAAAAATCTGATAAAAAGAATAAGAATAAGATCAAGGATTATTATAAAATA
ACAATAGTTCCTGGTTCCTCTTCCACGTCTACTAGCTCGTGGTATTATACACATGCCTAGTAATAGTCTCTTTG
CGTTGACGGAAAGCAGACTAGAAATAACAGGCTAAAATGTTCAGACACCATAATAGTTCCCAACCCAGATA
ATAACAGAGTACCATCAACACATTCCTTTAAACTCAATCCCAAACCCAAAACCGTTAAAATGTATCCGGCCA
ATTGATAGTAGATAATGAGGTGTACAGCGCATGATAATTTACACAGTAACCAAAATGAAAATACTTTAGTAAT
TATAAGAAATATAGATGGTAACGTCATCATCAACAATCCAATAATATGCCGGAGAGTAAACATTGACGGATAA
AACAAAAATGCTCCGCATAACTCTATCATGGCAATAACACAACCAAATACTTGTAAGATTCCTAAATTAGTAG
AAAATACAACGGATATCGATGTATAAGTGATCTCGAGAAATAATAAGAATAAAGTAATGCCCGTAAAGATAA
ACATCAACATTGTTTGGTAATCATTAAACCAATTAGTATGAAGTTGAACTAATTTCACAGTAGATTTTATTCCA
GTATTATCCCGCATGTATAAGTACCTGGTAAGATATCTTTATATTCCATAATCAATGAGACATCACTATCTGATA
ACGAATGAAGTCTAGCACTAGTATGCCATTTACTTAATATTGTCGTCTTGGAAGTTTTATTATAAGTTAAAATA
TCATGGTTATCCAATTTCCATCTAATATACTTTGTCGGATTATCTATAGTACACGGAATAATGATGGTATCATTA
CATGCTGTATACTCTATGGTCTTTGTAGTTGTTATAACAACCAACGTATAGAGGTATATCAACGATATTCTAAC
TCTTGACATTTTTTATTTATTTAAAATGATACCTTTGTTATTTATTTTATTCTATTTTGCTAACGGTATTGAATGG
CATAAGTTTGAAACGAGTGAAGAAATAATTTCTACTTACTTATTAGACGACGTATTATACACGGGTGTTAATG
GGGCGGTATACACATTTTCAAATAATAAACTAAACAAAACTGGTTTAACTAATAATAATTATATAACAACATCT
ATAAAAGTAGAGGATGCGGAACCAATAACGGAAATCCCAAATGTTGGAAAATAGACGGTTCAGACGACCC
AAAACATAGAGGTAGAGGATACGCTCCTTATCAAAATAGCAAAGTAACGATAATCAGTCACAACGGATGTG
TACTATCTGACATAAACATATCAAAAGAAGGAATTAAACGATGGAGAAGATTTGACGGACCATGTGGTTAT
GATTTATACACGGCGGATAACGTAATTCCAAAAGATGGTTTACGAGGAGCATTCGTCGATAAAGATGGTAC
TTATGACAAAGTTTACATTCTTTTCACTGATACTATCGGCTCAAAGAGAATTGTCAAAATTCCGTATATAGCA
CAAATGTGCCTAAACGACGAAGGTGGTCCATCATCATTGTCTAGTCATAGATGGTCGACGTTTCTCAAAGTC
GAATTAGAATGTGATATCGACGGAAGAAGTTATAGACAAATTATTCATTCTAGAACTATAAAAACAGATAAT
GATACGATACTATATGTATTCTTCGATAGTCCTTATTCCAAGTCCGCATTATGTACCTATTCTATGAATACCATTA
AACAATCTTTTTCTACGTCAAAATTGGAAGGATATACAAAGCAATTGCCGTCTCCAGCTCCTGGTATATGTTT
ACCAGCTGGAAAAGTTGTTCCACATACCACGTTTGAAGTCATAGAAAAATATAATGTACTAGATGATATTATA
AAGCCTTTATCTAACCAACCTATCTTCGAAGGACCGTCTGGTGTTAAATGGTTCGATATAAAGGAGAAGGA
AAATGAACATCGGGAATATAGAATATACTTCATAAAAGAAAATTCTATATATTCGTTCGATACAAAATCTAAAC
AAACTCGTAGCTCGCAAGTCGATGCGCGACTATTTTCAGTAATGGTAACTTCGAAACCGTTATTTATAGCAG
ATATAGGGATAGGAGTAGGAATGCCACAAATGAAAAAAATACTTAAAATGTAATCTTAATCGAGTACACCGC
ACGACAATGAACAAACATAAGACAGATTATGCTGGTTATGCTTGCTGCGTAATATGCGGTCTAATTGTTGGA
ATTATTTTTACAGCGACACTATTAAAAGTTGTAGAACGTAAATTAGTTCATACACCATCAATAGATAAAACGA
TAAAAGATGCATATATTAGAGAAGATTGTCCTACTGACTGGATAAGCTATAATAATAAATGTATCCATTTATCT
ACTGATCGAAAAAACCTGGGAGGAAGGACGTAATGCATGCAAAGCTCTAAATCCAAATTCGGATCTAATTA
AGATAGAGACTCCAAACGAGTTAAGTTTTTAAGAAGCCTTAGACGAGGCTATTGGGTAGGAGAATCCGAA
ATATTAAACCAGACAACCCATATAATTTTATAGCTAAAAATGCCACGAAGAATGGAACTAAAAAACGGAAAT

<div style="text-align:center">*FIG.15AT*</div>

ATATTTGTAGTACAACGAATACTCCCAAACTGCATTCGTGTTACACTATATAACAATTACACTACATTTTTATCA
TAACACTACTTCGGTTAGATGTTTTAGAAAAAAATAAATATCGCCGTACCGTTCTTGTTTTTATAAAAATAAC
AATTAACAATTATCAAATTTTTTCTTTAATATTTTACGTGGTTGACCATTCTTGGTGGTAAAATAATCTCTTAGT
GTTGGAATGGAATGCTGTTTAATGTTTCCGCACTCATCGTATATTTTGACGTATGCAGTCACATCGTTTACGC
AATAGTCAGACTGTAGTTCTATCATGCTTCCTACATCAGAAGGAGGAACAGTTTTAAAGTCTCTTGGTTTTA
ATCTATTGCCATTAGTTTTCATGAAATCCTTTGTTTTATCCACTTCACATTTTAAATAAATGTCCACTATACATT
CTTCTGTTAATTTTACTAGATCGTCATGGGTCATAGAATTTATAGGTTCCGTAGTCCATGGATCCAAACTAGC
AAACTTCGCGTATACGGTATCGCGATTAGTGTATACACCAACTGTATGAAAATTAAGAAAACAGTTTAATAA
ATCAACAGAAATATTTAATCCTCCGTTTGATACAGATGCGCCATATTTATGGATTTCGGATTCACACGTTGTTT
GTCTGAGGTGTTCGTCTAGTGTTGCTTCTACGTAAACTTCGATTCCCATATATTCTTTATTGTCAGAATCGCAT
ACCGATTTATCATCATACACTGTTTGAAAACTAAATGGTATACACATCAAAATAATAAATAATAACGAGTACAT
TCTGCAATATTGTTATCGTAATTGGAAAATTAGTGTTCGAGTGAGTCGGATTATGTGAGTACTGGATTGTATA
TTTTATTTTATATTTTGTAATAAGAATAAAATGCTAATGTCAAGTTTATTCCAATAGATGTCTTATTAAAAAACA
TATATAATAAATAACAATGGCTGAATGGCATAAAATTATCGAGGATATCTCAAAAAATAATAAGTTCGAGGAT
GCCGCCATCGTTGATTACAAGACTACAAAGAATGTTCTAGCTGCTATTCCTAACAGAACATTTGCCAAGATT
AATCCGGGTGAAATTATTCCTCTCATCACTAATCGTAATATTCTAAAACCTCTTATTGGTCAGAAATATTGTATT
GTATATACTAACTCTCTAATGGATGAGAACACGTATGCTATGGAGTTGCTTACTGGGTACGCCCCTGTATCTC
CGATCGTTATAGCGAGAACTCATACCGCACTTATATTTTTGATGGGTAAGCCAACAACATCCAGACGTGATG
TGTATAGAACGTGTAGAGATCACGCTACCCGTGTACGCGCAACTGGTAATTAAAATAAAAAGTAATATTCAT
ATGTAGTGTCAATTTTAAATGATGATGATGAAATGGATAATATCCATATTGACGATGTCAATAATGCCGGTATT
GGCATACAGCTCATCGATTTTTAGATTTCATTCAGAGGATGTGGAATTATGTTATGGGCATTTGTATTTTGAT
AGGATCTATAATGTAGTAAATATAAAATATAATCCGCATATTCCATATAGATATAATTTTATTAATCGCACGTTAA
CCGTAGATGAACTAGACGATAATGTCTTTTTTACACATGGTTATTTTTTAAAACACAAATATGGTTCACTTAAT
CCTAGTTTGATTGTCTCATTATCAGGAAACTTAAAATATAATGATATACAATGCTCAGTAAATGTATCGTGTCT
CATTAAAAATTTGGCAACGAGTACATCTACTATATTAACATCTAAACATAAGACTTATTCTCTACATCGGTCCA
CGTGTATTACTATAATAGGATACGATTCTATTATATGGTATAAAGATATAAATGACAAGTATAATGACATCTATG
ATTTTACTGCAATATGTATGCTAATAGCGTCTACATTGATAGTGACCATATACGTGTTTAAAAAAATAAAAATG
AACTCTTAATTATGCTATGCTATTAGAAATGGATAAAATCAAAATTACGGTTGATTCAAAAATTGGTAATGTT
GTTACCATATCGTATAACTTGGAAAAGATAACTATTGATGTTACACCTAAAAAGAAAAAAGAAAGGATGTA
TTATTAGCGCAATCAGTTGCTGTCGAAGAGGCAAAAGATGTCAAGGTAGAAGAAAAAAATATTATCGATAT
TGAAGATGACGATGATATGGATGTAGAAAGCGCATAATACGATCTATAAAAATAAGTATATAATAAATACTTTT
ATTTACGGTACTCTTGTAGTGGTGATACCCTACTCAATTATTTTTTAAAAAATACTTATTCTGATTCTTCTAGC
CATTTCCGTGTTCGTTCGAATGCCACATCGACGTTAAAGATAGGGGAGTAGTTGAAATCTAGTTCTGCATTG
TTGGTACGCACCTCAAATGTAGTGTTGGATATCTTCAACGTATAGTTGTTGAGTAGTGATGGTTTTCTAAATA
GAATTCTCTTCATATCATTCTTGCACGCGTACATTTTTAGCATCCATCTTGGAATTCTAGATCCTTGTTCTATTC
CCAATGGTTTCATCAATAGAAGATTAAACATATCGTACGAACACGATGGAGAGTAATCGTAGCAAAAGTAA
GCATTTCCTTTAATCTTAGATCCCGGATACTGGATATATTTTGCAGCCAACACGTGCATCCATGCAGCATTTC
CTACATATACCCGGCTATGCACCGCGTCATCATCGACTGTACGATACATAATGTTACCGTGTTGCTTACATTGC
TCGTAAAAGACTTTCGTCAATTTGTCTCCTTCTCCGTAAATTCCAGTGGGTCTTAGGCAACAAGTATACAATT
TTGCTCCATTCATGATTACGGAATTATTGGCTTTCATAACCAGTTGCTCGGCCATACGTTTACTTTTTGCGTAT
ACATGTCCTGGTGATATATCATAAAGGGTATGCTCATGGCCGATGAATGGATCACCGTGTTTATTGGGTCCTA
TTGCTTCCATGCTACTAGTATAGATCAAATACTTGATTCCTAGGTCCACACAAGCTGCCAATATAGTCTGTGTT
CCATAATAGTTTACTTTCATGATTTCATTATCGGTGTATTTTCCAAATACATCCACTAGAGCAGCCGTATGAAT
AATCAGATTTACCCCATCTAGCGCTTCTCTCACCTTATCAAAGTCGTTTATATCACATTGTATATAGTTTATAAC

*FIG.15AU*

CTTAACTTTCGAGGTTATTGGTTGTGGATCTTCTACAATATCTATGACTCTGATTTCTTGAACATCATCTGCAC
TAATTAACAGTTTTACTATATACCTGCCTAGAAATCCGGCACCACCAGTAACCGCGTACACGGCCATTGCTGC
CACTCATAATATCAGACTACTTATTCTATTTTACTAAATAATGGCTGTTTGTATAATAGACCACGATAATATCAG
AGGAGTTATTTACTTTGAACCAGTCCATGGAAAAGATAAAGTTTTAGGATCAGTTATTGGATTAAAATCCGG
AACGTATAGTTTGATAATTCATCGTTACGGAGATATTAGTCAAGGATGTGATTCCATAGGCAGTCCAGAAATA
TTTATCGGTAACATCTTTGTAAACAGATATGGTGTAGCATATGTTTATTTAGATACAGATGTAAATATATTTACA
ATTATTGGAAAGGCGTTATCTATTTCAAAAAATGATCAGAGATTAGCGTGTGGAGTTATTGGTATTTCTTACA
TAAATGAAAGATAATACATTTTCTTACAATTAACGAGAATGGCGTTTGATATATCAGTTAATGCGTCTAAAA
CAATAAATGCATTAGTTTACTTTTCTACTCAGCAAAATAAATTAGTCATACGTAATGAAGTTAATGATACACAC
TACACTGTCGAATTTGATAGGGACAAAGTAGTTGACACGTTTATTTCATATAATAGACATAATGACACCATAG
AGATAAGAGGGGTGCTTCCAGAGGAAACTAATATTGGTTGCGCGGTTAATACGCCGGTTAGTATGACTTAC
TTGTATAATAAGTATAGTTTTAAACTGATTTTAGCAGAATATATAAGACACAGAAATACTATATCCGGCAATAT
TTATTCGGCATTGATGACACTAGATGATTTGGCTATTAAACAGTATGGAGACATTGATCTATTATTTAATGAG
AAACTTAAAGTAGACTCCGATTCGGGACTATTTGACTTTGTCAACTTTGTAAAGGATATGATATGTTGTGATT
CTAGAATAGTAGTAGCTCTATCTAGTCTAGTATCTAAACATTGGGAATTGACAAATAAAAAGTATAGGTGTAT
GGCATTAGCCGAACATATATCTGATAGTATTCCAATATCTGAGCTATCTAGACTACGATACAATCTATGTAAGT
ATCTACGCGGACACACTGAGAGCATAGAGGATGAATTTGATTATTTTGAAGACGATGATTCGTCTACATGTT
CTGCCGTAACCGACAGGGAAACGGATGTATAATTTTTTTTATAGCGTGAAGGATATGATAAAAAATATAATT
GTTGTATTTATCCCATTCCAATCACCTTATATGATTCTGTAAAAAATTATACTGTAACACAATAAAGGAGTCT
TATAGATGTATAGAGGTCAGATACTGGTTTGATAAACTGTTTATTCCACATAAGTATGTTTGACTTTATGGTTA
GACCCGCATACTTTAACAAATCACTGAAAATTGGAGTTAGGTATTGACCTCTCAGAATCAGTTGCCGTTCTG
GAACATTAAATGTATTTTTTATGATATACTCCAACGCATTTATGTGGGCATACAACAAGTCATTACTAATGGAG
TATTCCAAGAGTTTTAGTTGTCTAGTATTTAACAAGAGAAGAGATTTCAACAGACTGTTTATGAACTCGAAC
GCCGCCTCATTGTCGCTTATATTGATGATGTCGAATTCTCCCAATATCATCACTGATGAGTAGCTCATCTTGTT
ATCGGGATCCAAGTTTTCTAAAGATGTCATTAAACCCTCGATCATGAATGGATTTATCATCATCGTTTTTATGT
TGGACATGAGCTTAGTCCGTTTGTCCACATCTATAGACGACGATTTCTGAATTATTTCATATATCCCTCTCTTT
AACTCCAGGAACTTGTCAGGATGGTCTACTTTAATATGTTCTCGTCTAAGAGATGAAAATCTTTGGATGGTT
GCACGCGACTTTTCTTTAAAGGATGACGTTGCCCAAGATCCTCTCTTAAATGAATCCATCTTATCCTTGGAC
AAGATGGACAGTCTATTTTCCTTAGATGGTTTAATATTTTTGTTACCCATGATCTATAAAGGTAGACCTAATCG
TCTCGGATGACCATATATTTATTTTCAGTTTTATTATACGCATAAATTGTAAAAAATATGTTAGGTTTACAAAA
ATGTCTCGTGGGGCATTAATCGTTTTTGAAGGATTGGACAAATCTGGAAAAACAACACAATGTATGAACAT
CATGGAATCTATACCGGCAAACACGATAAAATATCTTAACTTTCCTCAGAGATCCACTGTCACTGGAAAGAT
GATAGATGACTATCTAACTCGTAAAAAAACCTATAATGATCATATAGTTAATCTATTATTTTGTGCAAATAGATG
GGAGTTTGCATCTTTTATACAAGAACAACTAGAACAGGGAATTACTTTAATAGTTGATAGATACGCATTTTCT
GGAGTAGCGTATGCCGCCGCTAAAGGCGCGTCAATGACTCTCAGTAAGAGTTATGAATCTGGATTGCCTAA
ACCCGACTTAGTTATATTCTTGGAATCTGGTAGCAAAGAAATTAATAGAAACGTCGGCGAGGAAATTTATGA
AGATGTTACATTCCAACAAAAGGTATTACAAGAATATAAAAAAATGATTGAAGAAGGAGATATTCATTGGCA
AATTATTTCTTCTGAATTCGAGGAAGATGTAAAGAAGGAGTTGATTAAGAATATAGTTATAGAGGCTATACA
CACGGTTACTGGACCAGTGGGGCAACTGTGGATGTAATAGTGAAATTACATTTTTTATAAATAGATGTTAGT
ACAGTGTTATAAATGGATGAAGCATATTACTCTGGCAACTTGGAATCAGTACTCGGATACGTGTCCGATATG
CATACCGAACTCGCATCAATATCTCAATTAGTTATTGCCAAGATAGAAACTATAGATAATGATATATTAAACAA
GGACATTGTAAATTTTATCATGTGTAGATCAAACTTGGATAATCCATTTATCTCTTTCCTAGATACTGTATATAC
TATTATAGATCAAGAGATCTATCAGACCGAATTGATTAATTCATTAGACGACAATGAAATTATCGATTGTATAG
TTAACAAGTTTATGAGCTTTTATAAGGATAACCTAGAAAATATAGTAGATGCTATCATTACTCTAAAATATATA

FIG.15AV

ATGAATAATCCAGATTTTAAAACTACGTATGCCGAAGTACTCGGTTCCAGAATAGCCGATATAGATATTAAAC
AAGTGATACGTAAGAATATACTACAATTGTCTAATGATATCCGCGAACGATATTTGTGAAAAATATTAAAAAA
AAATACTTTTTTTATTAAATGACGTCGCTTCGCGAATTTAGAAAATTATGCTGTGATATATATCACGCATCAGG
ATATAAAGAAAAATCTAAATTAATTAGAGACTTTATAACAGATAGGGATGATAAATATTTGATCATTAAGCTAT
TGCTTCCCGGATTAGACGATAGAATTTATAACATGAACGATAAACAAATTATAAAATTATATAGTATAATATTTA
AACAATCTCAGGAAGATATGCTACAAGATTTAGGATACGGATATATAGGAGACACTATTAGGACTTTCTTCA
AAGAGAACACAGAAATCCGTCCACGAGATAAAAGCATTTTAACTTTAGAAGAAGTGGATAGTTTTTTAACT
ACGTTATCATCCGTAACTAAAGAATCGCATCAAATAAAATTATTGACTGATGTAGCATCTGTTTGTACATGTAA
TGATTTAAAATGTGTAGTCATGCTTATTGATAAAGATCTAAAAATTAAAGCGGGCCCTCGGTACGTACTTAAC
GCTATTAGTCCTCATGCCTATGATGTGTTTAGAAAATCTAATAACTTGAAAGAGATAATAGAAAATGCATCTA
AACAAAATCTAGACTCTATATCTATTTCTGTTATGACTCCAATTAATCCCATGTTAGCGGAATCGTGTGATTCT
GTCAATAAGGCGTTTAAAAAATTTCCATCAGGAATGTTTGCGGAAGTCAAATACGATGGTGAAAGAGTACA
AGTTCATAAAAATAATAACGAGTTTGCCTTCTTTAGTAGAAACATGAAACCAGTACTCTCTCATAAAGTGGA
TTATCTCAAAGAATACATACCGAAAGCATTTAAAAAAGCTACGTCTATCGTATTGGATTCTGAAATTGTTCTT
GTAGACGAACATAATGTACCGCTACCGTTTGGAAGTTTAGGAATACACAAAAAGAAAGAATATAAAAACTC
TAACATGTGTTTGTTCGTGTTTGACTGTTTGTACTTTGATGGATTCGATATGACGGACATTCCATTGTACGAA
CGAAGATCTTTTCTCAAAGATGTTATGGTTGAAATACCCAATAGAATAGTATTCTCAGAGTTGACGAATATTA
GTAACGAGTCTCAGTTAACTGACGTATTGGATGATGCACTAACGAGAAAATTAGAAGGATTGGTCTTAAAA
GATATTAATGGAGTATACGAACCGGGAAAGAGAAGATGGTTAAAAATAAAGCGAGACTATTTGAACGAGG
GTTCCATGGCAGATTCTGCCGATTTAGTAGTACTAGGTGCCTACTATGGTAAAGGAGCAAAGGGTGGTATC
ATGGCAGTCTTTCTAATGGGTTGTTACGACGATGAATCCGGTAAATGGAAGACGGTTACCAAGTGTTCAGG
ACACGATGATAATACGTTAAGGGAGTTGCAAGACCAATTAAAGATGATTAAAATTAACAAGGATCCCAAAA
AAATTCCAGAGTGGTTAGTAGTTAATAAAATCTATATTCCCGATTTTGTAGTAGAGGATCCGAAACAATCTCA
GATATGGGAAATTTCAGGAGCAGAGTTTACATCTTCCAAGTCCCATACCGCAAATGGAATATCCATTAGATT
TCCTAGATTTACTAGGATAAGAGAGGATAAAACGTGGAAAGAATCTACTCATCTAAACGATTTAGTAAACTT
GACTAAATCTTAATAGTTACATACAAACTGAAAATTAAAATAACACCATTTAGTTGGTGGTCGCCATGGATG
GTGTTATTGTATACTGTCTAAACGCGTTAGTAAAACATGGCGAGGAAATAAATCATATAAAAATGATTTCATG
ATTAAACCATGTTGTGAAAGAGTTTGTGAAAAAGTCAAGAACGTTCACATTGGCGGACAATCTAAAAACA
ATACAGTGATTGCAGATTTGCCATATATGGATAATGCGGTATCCGATGTATGCAATTCACTGTATAAAAAGAA
TGTATCAAGAATATCCAGATTTGCTAATTTGATAAAGATAGATGACGATGACAAGACTCCTACTGGTGTATAT
AATTATTTTAAACCTAAAGATGTTATTCCTGTTATCATATCTATAGGAAAGGATAAAGATGTCTGTGAACTATT
AATCTCATCAGACATATCGTGTGCATGCGTGGAGTTAAATTCATATCACGTAGCCATTCTTCCCATGAATGTTT
CCTTTTTTACCAAAGGAAATGCCTCGTTGATTATTCTCCTGTTTGATTTCTCTATCGATGCAGCACCTCTCTTA
AGAAGTGTAACCGATAATAATGTTATTATATCTAGACACCAGCGTCTACATGACGAGCTTCCGAGTTCCAATT
GGTTCAAGTTTTACATAAGTATAAAGTCCGACTATTGTTCTATATTATATATGGTTGTTGATGGATCTGTGATG
CATGCGATAGCTGATAATAGAACTCACGCAATTATTAGCAAAAATATATTAGACAATACTACAATTAACGATG
AGTGTAGATGCTGTTATTTTGAACCACAGATTAGGATTCTTGATAGAGATGAGATGCTCAATGGATCATCGT
GTGATATGAACAGACATTGTATTATGATGAATTTACCTGATGTAGGCGAATTTGGATCTAGTATGTTGGGGA
AATATGAACCTGACATGATTAAGATTGCTCTTTCGGTGGCTGGTAATTTAATAAGAAATCGAGACTACATTCC
CGGGAGACGAGGCTATAGCTACTACGTTTACGGTATAGCCTCTAGATAATTTTTTTAAGCACGAAATAAAAA
ACATAATTTTAAACCAATCTATTTCATACTATTTTGTGTGATCACCATGGACATAAAGATAGATATTAGTATTTC
TGGTGATAAATTTACGGTGACTACTAGGAGGGAAAATGAAGAAAGAAAAAAATATCTACCTCTCCAAAAA
GAAAAAACTACTGATGTTATCAAACCTGATTATCTTGAGTACGATGACTTGTTAGATAGAGATGAGATGTTT
ACTATTCTAGAGGAATATTTTATGTACAGAGGTCTATTAGGCCTCAGAATAAAATATGGACGACTCTTTAACG

<div align="center"><em>FIG.15AW</em></div>

AAATTAAAAAATTCGACAATGATGCGGAAGAACAATTCGGTACTATAGAAGAACTCAAGCAGAAACTTAG
ATTAAATTCTGAAGAGGGAGCAGATAACTTTATAGATTATATAAAGGTACAAAAACAGGATATCGTCAAACT
TACTGTATACGATTGCATATCTATGATAGGATTGTGTGCATGCGTGGTAGATGTTTGGAGAAATGAGAAACT
GTTTTCTAGATGGAAATATTGTTTACGAGCGATTAAACTGTTTATTAATGATCACATGCTTGATAAGATAAAA
TCTATACTGCAGAATAGACTAGTATATGTGGAAATGTCATAGAAAGTTAATGAGAGCAAAAATATATAAGGTT
GTATTCCATATTTGTTATTTTTTCTGTAATAGTTAAAAAAATACATTCGATGGTCTATCTATCAGATTATTATGTG
TTATAAGGTACTTTTTCTCATAATAAACTAGAGTATGAGTAAGATAGTGTTTTTCAAAACATATAAATCTAAAA
TTGATGGATGAGATATACAGCTATTAATTTCGAAAATATATAAATCTAAAATTGATGGATAAGATATACAGCTA
TTAATTTCGAAAATATATTTTAATCTGATAACTTTAAACATGGATTTTTGATGGTGGTTTAACGTTTTAAAAAA
AGATTTTGTTATTGTAGTATATGATAATATTAAAAGATGGATATAAAGAATTTGCTGACTGCATGTACTATTTTT
TACATTACTACATTGGCTACGGCAGATATACCTACTCCGCCACCAACGGGTCATGTGACAAGGGAGAATATC
TTGATAAGAGGCATAATCAATGTTGTAATCGGTGTCCACCTGGAGAATTTGCCAAGGTTAGATGTAATGGTA
ACGATAACACAAAATGTGAACGCTGCCCACCTCATACATATACCACAATCCCCAATTATTCTAATGGATGTCA
TCAATGTAGAAAATGCCCAACCGGATCATTTGATAAGGTAAAGTGTACCGGAACACAGAACAGTAAATGTT
CGTGTCTTCCTGGTTGGTATTGCGCTACTGATTCTTCACAGACTGAAGATTGTTGAAATTGTGTACCAAAAA
GGAGATGTCCATGCGGATACTTTGGTGGAATAGATGAACAAGGAAATCCTATTTGTAAATCGTGCTGTATTG
GTGAATATTGCAACTACCTACGTAATTATAGACTTGATCCATTTTCTCCATGCAAACTATCTAAATGTAATTAAT
TATGATTTTGATGATAATGTTACCATACATTATATCGCTACTTGGTTAGTGTATTATTCAGTATGAAGACCTATT
AATAATTACTTATCTTTTGACGATCTTGTTATAATTATAATATAAAAACTTATGGCATAGTAACTCATAATTGCT
GACGCGATAAATTCGTAATAATCTGTTTTGTTCAAATTTTTATAAGGAATCTACAGGCATAAAAATAAAAATA
TAATTTATAATATACTCTTACAGCGCGCCATCATGAATAGCAGCAGTAAATTAATTGCTGTTATTAATGGATTT
AGAAATAGTGGACGATTTTGTGATATTAATATAGTTATTAATGATGAAAGGATAAACGCTCACAGACTCATCC
TATCTGGAGCCTCCGAATATTTTTCCATTCTGTTTTCCAATAATTTTATCGATTCTAATGAATACGAAGTTAATC
TAAGTCATTTAGATTATCAAAGTGTTAACGATTTGATCGATTACATTTATGGGATACCTTTGAGCCTAACTAAC
GATAACGTGAAATATATTCTTTCAACCGCTGATTTTTTACAAATTGGATCTGCCATTACTGAGTGCGAAAAAT
ACATACTTAAAAATCTTTGTTCTAGAAACTGTATCGATTTCTACATATACGCTGATAAATATAATAACAAGAAA
ATAGAATCAGCGTCGTTTAACACAATATTACGAAATATTTTGAGACTCATCAACGATGAAAACTTTAAATACT
TAACAGAGGAATCAATGATAAAAATTTTAAGCGATGATATGTTAAATATAAAAAATGAGGATTTTGCACCAC
TAATTCTCATTAAATGGTTAGAGAGTACTCAACAATCATGCACCGTCGAGTTACTTAGATGCCTCAGAATATC
ATTGCTTTCCCCACAAGTTATAAAATCACTTTATAGTCATCAACTGGTTAGTTCAATCTACGAATGTATAACAT
TCTTAAACAATATAGCATTCTTGGATGAATCATTTCCTAGATACCATAGCATCGAGTTGATATCTATCGGTATA
AGTAATTCGCATGATAAGATTTCCATAAACTGCTACAATCATAAAAAAAATACATGGGAAATGATATCTTCAC
GTAGATATAGGTGTAGTTTCGCAGTGGCCGTCCTGGATAATATTATCTATATGATGGGTGGATATGATCAGTC
CCCGTATAGAAGTTCAAAGGTTATAGCGTACAATACATGTACAAATTCTTGGATATATGATATACCAGAGCTA
AAATATCCTCGTTCTAATTGTGGGGACTGGCTGATGACGAATACATTTATTGTATAGGCGGCATACGCGATCA
GGATTCATCGTTGACATCTAGTATTGATAGATGGAAGCCATCAAAACCATATTGGCAGAAGTATGCTAAAAT
GCGCGAACCAAAATGTGATATGGGGGTTGCGATGTTAAACGGATTAATATATGTCATGGGTGGAATCGTTA
AAGGTGACACGTGTACCGACGCACTAGAGAGTTTATCAGAAGATGGATGGATGAAGCATCAACGTCTTCC
AATAAAAATGTCCAATATGTCGACGATTGTTCATGATGGCAAGATTTATATATCTGGAGGTTACAACAATAGT
AGTGTAGTTAATGTAATATCGAATCTAGTCCTTAGCTATAATCCGATATATGATGAATGGACCAAATTATCATCA
TTAAACATTCCTAGAATTAATCCCGCTCTATGGTCAGCGCATAATAAATTATATGTAGGAGGAGGAATATCTG
ATGATGTTCGAACTAATACATCTGAAACATACGATAAAGAAAAGATTGTTGGACATTGGATAATGGTCACG
TGTTACCACGCAATTATATAATGTATAAATGCGAACCGATTAAACATAAATATCCATTGGAAAAAACACAGTA
CACGAATGATTTTCTAAAGTATTTGGAAAGTTTTATAGGTAGTTGATAGAACAAAATACATAATTTTGTAAAA

FIG.15AX

ATAAATCACTTTTTATACTAATATGACACGATTACCAATACTTTTGTTACTAATATCATTAGTATACGCTACACCT
TTCCTCAGACATCTAAAAAATAGGTGATGATGCAACTCTATCATGTAATCGAAATAATACAAATGACTACGTT
GTTATGAGTGCTTGGTATAAGGAGCCCAATTCCATTATTCTTTTAGCTGCTAAAAGCGACGTCTTGTATTTTG
ATAATTATACCAAGGATAAAATATCTTACGACTCTCCATACGATGATCTAGTTACAACTATCACAATTAAATCAT
TGACTGCTAGAGATGCCGGTACTTATGTATGTGCATTCTTTATGACATCAACTACAAATGACACTGATAAAGT
AGATTATGAAGAATACTCCACAGAGTTGATTGTAAATACAGATAGTGAATCGACTATAGACATAATACTATCT
GGATCTACACATTCACCAGAAACTAGTTCTGAGAAACCAGAGGATATAGATAATTTTAATTGCTCGTCGGTA
TTCGAAATCGCGACTCCGGAACCAATTACTGATAATGTAGAAGATCATACAGACACCGTCACATACACTAGT
GATAGCATTAATACAGTAAGTGCATCATCTGGAGAATCCACAACAGACGAGACTCCGGAACCAATTACTGA
TAAAGAAGAAGATCATACAGTCACAGACACTGTCTCATACACTACAGTAAGTACATCATCTGGAATTGTCAC
TACTAAATCAACCACCGATGATGCGGATCTTTATGATACGTACAATGATAATGATACAGTACCACCAACTACT
GTAGGCGGTAGTACAACCTCTATTAGCAATTATAAAACCAAGGACTTTGTAGAAATATTTGGTATTACCGCAT
TAATTATATTGTCGGCCGTGGCAATATTCTGTATTACATATTATATATATAATAAACGTTCACGTAAATACAAAA
CAGAGAACAAAGTCTAGATTTTTGACTTACATAAATGTCTGGGATAGTAAAATCTATCATATTGAGCGGACC
ATCTGGTTCAGGAAAGACAGCCATAGCCAAAAGACTATGGGAATATATTTGGATTTGTGGTGTCCCATACCA
CTAGATTTCCTCGTCCTATGGAACGAGAAGGTGTCGATTACCATTACGTTAACAGAGAGGCCATCTGGAAG
GGAATAGCCGCCGGAAACTTTCTAGAACATACTGAGTTTTTAGGAAATATTTACGGAACTTCTAAAACTGCT
GTGAATACAGCGGCTATTAATAATCGTATTTGTGTGATGGATCTAAACATCGATGGCGTTAGAAGTCTTAAA
AATACGTACCTAATGCCTTACTCGGTGTATATAAGACCTACCTCTCTTAAAATGGTTGAGACCAAGCTTCGTT
GTAGAAACACTGAAGCGGATGATGAGATTCATCGTCGTGTGATGTTGGCAAAAACTGACATGGATGAGGC
AGGTGAAGCCGGTCTATTCGACACTATTATCATTGAAGATGATGTGAATTTAGCATATAGTAAGTTAATTCAG
ATACTACAGGACCGTATTAGAATGTATTTTAACACTAATTAGAGACTTAAGACTTAAAACTTGATAATTAATA
ATATAACTCGTTTTTATATGTGGCTATTTCAACGTCTAATGTATTAGTTAAATATTAAAACTTACCACGTAAAAC
TTAAAATTTAAAATGATATTTCATTGACAGATAGATCACACATTATGAACTTTCAAGGACTTGTGTTAACTGA
CAATTGCAAAAATCAATGGGTCGTTGGACCATTAATAGGAAAAGGTGGATTCGGTAGTATTTATACTACTAA
TGACAATAATTATGTAGTAAAAATAGAGCCCAAAGCTAACGGATCATTATTTACCGAACAGGCATTTTATACT
AGAGTACTTAAACCATCCGTTATCGAAGAATGGAAAAAATCTCACAATATAAAGCACGTAGGTCTTATCACG
TGCAAGGCATTTGGTCTATACAAATCCATTAATGTGGAATATCGATTCTTGGTAATTAATAGATTAGGTGCAG
ATCTAGATGCGGTGATCAGAGCCAATAATAATAGATTACCAAAAGGTCGGTGATGTTGATCGGAATCGAAAT
CTTAAATACCATACAATTTATGCACGAGCAAGGATATTCTCACGGAGATATTAAAGCGAGTAATATAGTCTTG
GATCAAATAGATAAGAATAAATTATATCTAGTGGATTACGGATTGGTTTCTAAATTCATGTCTAATGGCGAAC
ATGTTCCATTTATAAGAAATCCAAATAAAATGGATAACGGTACTCTAGAATTTACACCTATAGATTCGCATAAA
GGATACGTTGTATCTAGACGTGGAGATCTAGAAACACTTGGATATTGTATGATTAGATGGTTGGGAGGTATC
TTGCCATGGACTAAGATATCTGAAACAAAGAATTGTGCATTAGTAAGTGCCACAAAACAGAAATATGTTAAC
AATACTGCGACTTTGTTAATGACCAGTTTGCAATATGCACCTAGAGAATTGCTGCAATATATTACCATGGTAA
ACTCTTTGACATATTTTGAGGAACCCAATTACGACGAGTTTCGGCACATATTAATGCAGGGTGTATATTATTA
AGTGTGGTGTTTGGTCGATGTAAAATTTTTGTCGATAAAAATTAAAAAATAACTTAATTTATTATTGATCTCGT
GTGTACAACCGAAATCATGGCGATGTTTTACGCACACGCTCTCGGTGGGTACGACGAGAATCTTCATGCCT
TTCCTGGAATATCATCGACTGTTGCCAATGATGTCAGGAAATATTCTGTTGTGTCAGTTTATAATAACAAGTAT
GACATTGTAAAAGACAAATATATGTGGTGTTACAGTCAGGTGAACAAGAGATATATTGGAGCACTGCTGCC
TATGTTTGAGTGCAATGAATATCTACAAATTGGAGATCCGATCCATGATCAAGAAGGAAATCAAATCTCTATC
ATCACATATCGCCACAAAAACTACTATGCTCTAAGCGGAATCGGGTACGAGAGTCTAGACTTGTGTTTGGA
AGGAGTAGGGATTCATCATCACGTACTTGAAACAGGAAACGCTGTATATGGAAAAGTTCAACATGATTATTC
TACTATCAAAGAGAAGGCCAAAGAAATGAATGCACTCAGTTCAGGACCTATCATCGATTACCACGTCTGGA

FIG.15AY

```
TAGGAGATTGTATCTGTCAAGTTACTGCTGTGGACGTACATGGAAAGGAAATTATGAGAATGAGATTCAAA
AAGGGTGCGGTGCTACAGATCCCAAATCTGGTAAAAGTTAAACTTGGGGAGAATGATACAGAAAATCTTT
CTTCTACTATATCGGCGGCACCATCGAGGTAACCACCTCTCAAGAAGACCGCGTGAATAATGTACTCATGAA
CGTTTGGAAACTATACGCCATATGTGGTCTGTTGTATATGATCATTTTGATATTGTGAATGGTAAAGAATGCT
GTTATGTGCATACGCATTCATCTAATCAAAATCCTATACCGAGTACTGTAAAAACAAATTTGTACATGAAGAC
TATGGGATCATGCATTCAAATGGATTCCATGGAAGCTCTAGAGTATCTTAGCGAACTGAAGGAATCAGGTG
GATGGAGTCCCAGACCAGAAATGCAGGAATTTGAATATCCAGATGGAGTGGAAGACACTGAATCAATTGA
GAGATTGGTAGAGGAGTTCTTCAATAGATCAGAACTTCAGGCTGGTAAATTAGTCAAATTTGGTAATTCTAT
TAATTGTTAAACATACATCTGTTTCAGCTAAGCAACTAAGAACACGTATACGGCAGCAGCTTCCTTTTATACT
CTCATCTTTTACCAACACAAAGGGTGGATATTTGTTCATTGGAGTTGATAATAATACACACAAAGTATTTGGA
TTCACGGTGGGTTACGACTACCTCAGACTGATAGAGAATGATATAGAAAGCATATCAAAAGACTTTGTGTT
GTGCATTTCTGTGAGAAGAAAGAGGACATCAAGTACACGTGTCGATTCATCAAGGTATATAAACCTGGGGA
TGAGGCTACCTCGACATACGTGTGCGCTATCAAAGTGGAAAGATGCTGTTGTGCTGTGTTTGCAGATTGGC
CAGAATCATGGTATATGGATACTAATGGTATCAAGAAGTATTCTCCAGATGAATGGGTGTCACATATAAAATT
TTAATTAATGTAACTATAGAGAACAAATAATAGGTTGTAATATCATATAGACAATAACTAACAATTAATTAGTA
ACTGTTATCTCTTTTTTAACTAACCAACTAACTATATACCTATTAATACATCGTAATTATAGTTCTTAACATCTAT
TAATCATTGATTCGCTTCTTTAATTTTTATAAACTAACATTGTTAATTGAAAAGGGATAACATGTTACAGAATA
TAAATTATATATGGATTTTTTTAAAAAGGAAATACTTGACTGGAGTGTATATTTATCTCTTCATTATATAGCACG
CGTGTGTTCCAATTCTTCCACATCCCATATAATACAGGATTATAATCTCGTTCGAACATACGAGAAAGTGGAT
AAAACAATAGTTGATTTTTTATCTAGGTTGCCAAATTTATTCCATATTTTAGAATATGGGGAAAATATTCTACA
TATTTATTCTATGGATGATGCTAATACGAATATTATAATTTTTTTTTCTAGATAGAGTATTAAATATTAATAAGAAC
GGGTCATTTATACACAATCTCAGGTTATCATCATCCATTAATATAAAAGAATATGTATATCAATTAGTTAATAAT
GATCATCCAGATAATAGGATAAGACTAATGCTTGAAAATGGACGTAGAACAAGACATTTTTTGTCCTATATAT
CAGATACAGTTAATATCTATATATGTATTTTAATAAATCATGGATTTTATATAGATGCAGAAGACAGTTACGGTT
GTACATTATTACATAGATGTATATATCACTATAAGAAATCAGAATCAGAATCATACAATGAATTAATTAAGATAT
TGTTAAATAATGGATCCGATGTAGATAAAAAGATACGTACGGAAACACACCTTTTATCCTATTATGTAAACAC
GATATCAACAACGTGGAATTGTTTGAGATATGTTTAGAGAATGCTAATATAGACTCTGTAGACTTTAATAGAT
ATACACCTCTTCATTATGTCTCATGTCGTAATAAATATGATTTTGTAAAGTTATTAATTTCTAAAGGAGCAAAT
GTTAATGCGCGTAATAAATTCGGAACTACTCCATTTTATTGTGGAATTATACACGGTATCTCGCTTATAAAACT
ATATTTGGAATCAGACACAGAGTTAGAAATAGATAATGAACATATAGTTCGTCATTTAATAATTTTTGATGCT
GTTGAATCTTTAGATTATCTATTATCCAGAGGAGTTATTGATATTAACTATCGTACTATATACAACGAAACATCT
ATTTACGACGCTGTCAGTTATAATGCGTATAATACGTTGGTCTATCTATTAAACAGAAATGGTGATTTTGAGA
CGATTACTACTAGTGGATGTACATGTATTTCGGAAGCAGTCGCAAACAACAACAAAATAATAATGGAAGTAC
TATTGTCTAAACGACCATCTTTGAAAATTATGATACAGTCTATGATAGCAATTACTAAAAATAAACAACATAAT
GCAGATTTATTGAAAATGTGTATAAAATATACTGCGTGTATGACCGATTATGATACTCTTATAGATGTACAGTC
GCTACAGCAATATAAATGGTATATTTTAAAATGTTTCGATGAAATAGATATCATGAAGAGATGTTATATAAAAA
ATAAAACTGTATTCCAATTAGTTTTTTGTATCAAAGACATTAATACTTTAATGAGATATGGTAAACATCCTTCT
TTCGTGAAGTGCACTAGTCTCGACGTATACGGAAGTCGTGTACGTAATATCATAGCATCTATTAGATATCGTC
AGAGATTAATTAGTCTATTATCCAAGAAGCTGGATGCGGGAGATAAATGGTCGTGTTTTCCTAACGAAATAA
AATATAAAATATTGGAAAACTTTAACGATAACGAACTATCCACATATCTAAAAATCTTATAAACACTATTAAAA
TATAAAATCTAAGTAGGATAAAATCACACTACATCATTGTTTCCTTTTAGTGCTCGACAGTGTATACTATTTTT
AACACTCATAAATAAAAATGAAAACGATTTCCGTTGTTACGTTGTTATGCGTACTACCTGCTGTTGTTTATTC
AACATGTACTGTACCCACTATGAATAACGCTAAATTAACGTCTACCGAAACATCGTTTAATGATAAACAGAAA
GTTACATTTACATGTGATCAGGGATATCATTCTTTGGATCCAAATGCTGTCTGCGAAACAGATAAATGGAAAT
```

ACGAAAATCCATGCAAGAAAATGTGCACAGTTTCTGATTATGTCTCTGAATTATATGATAAGCCATTATACGA
AGTGAATTCCACCATGACACTAAGTTGCAACGGCGAAACAAAATATTTTCGTTGCGAAGAAAAAAATGGA
AATACTTCTTGGAATGATACTGTTACGTGTCCTAATGCGGAATGTCAACCTCTTCAATTAGAACACGGATCGT
GTCAACCAGTTAAAGAAAAATACTCATTTGGGGAATATATGACTATCAACTGTGATGTTGGATATGAGGTTA
TTGGTGCTTCGTACATAAGTTGTACAGCTAATTCTTGGAATGTTATTCCATCATGTCAACAAAAATGTGATATA
CCGTCTCTATCTAATGGATTAATTTCCGGATCTACATTTTCTATCGGTGGCGTTATACATCTTAGTTGTAAAAG
TGGTTTTATACTAACGGGATCTCCATCATCCACATGTATCGACGGTAAATGGAATCCCATACTCCCAACATGT
GTACGATCTAACGAAAAATTTGATCCAGTGGATGATGGTCCGACGATGAGACAGATTTGAGCAAACTCTCG
AAAGACGTTGTACAATATGAACAAGAAATAGAATCGTTAGAAGCAACTTATCATATAATCATAGTGGCGTTA
ACAATTATGGGCGTCATATTTTTAATCTCCGTTATAGTATTAGTTTGTTCCTGTGACAAAAATAATGACCAATA
TAAGTTCCATAAATTGCTACCGTAAATATAAATCCGTTAAAATAATTAATAATTTAATAACAAACAAGTATCAA
AAGATTAAAGACTTATAGCTAGAATCAATTGAGATGTCTTCTTCAGTGGATGTTGATATCTACGATGCCGTTA
GAGCATTTTTACTCAGGCACTATTATAACAAGAGATTTATTGTGTATGGAAGAAGTAACGCCATATTACATAA
TATATACAGGCTATTTACAAGATGCGCCGTTATACCGTTCGATGATATAGTACGTACTATGCCAAATGAATCAC
GTGTTAAACAATGGGTGATGGATACACTTAATGGTATAATGATGAATGAACGCGATGTTTCTGTAAGCGTTG
GCACCGGAATACTATTCATGGAAATGTTTTTCGATTACAATAAAAATAGTATCAACAATCAACTAATGTATGAT
ATAATTAATAGCGTATCTATAATTCTAGCTAATGAGAGATATAGAAGCGCTTTTAACGACGATGGTATATACAT
CCGTAGAAATATGATTAACAAGTTGTACGGATACGCATCTCTAACTACTATTGGCACGATCGCTGGAGGTGT
TTGTTATTATCTGTTGATGCATCTAGTTAGTTTGTATAAATAATTATTTCAATATACTAGTTAAAATTTTAAGATT
TTAAATGTATAAAAAACTAATAACGTTTTTATTTGTAATAGGTGCATTAGCATCCTATTCGAATAATGAGTACA
CTCCGTTTAATAAACTGAGTGTAAAACTCTATATAGATGGAGTAGATAATATAGAAAATTCATATACTGATGAT
AATAATGAATTGGTGTTAAATTTTAAAGAGTACACAATTTCTATTATTACAGAGTCATGCGACGTCGGATTTG
ATTCCATAGATATAGATGTTATAAACGACTATAAAATTATTGATATGTATACCATTGACTCGTCTACTATTCAAC
GCAGAGGTCACACGTGTAGAATATCTACCAAATTATCATGCCATTATGATAAGTACCCTTATATTCACAAATAT
GATGGTGATGAGCAACAATATTCTATTACTGCAGAGGGAAAATGCTATAAAGGAATAAAATATGAAATAAGT
ATGATCAACGATGATACTCTATTGAGAAAACATACTCTTAAAATTGGATCTACTTATATATTTGATCGTCATGG
ACATAGTAATACATATTATTCAAAATATGATTTTTAAAAATTTAAAATATATTATCACTTCAGTGACAGTAGTCA
AATAACAAACAACACCATGAGATATATTATAATTCTCGCAGTTTTGTTCATTAATAGTATACACGCTAAAATAA
CTAGTTATAAGTTTGAATCCGTCAATTTTGATTCCAAAATTGAATGGACTGGGGATGGTCTATACAATATATC
CCTTAAAAATTATGGCATCAAGACGTGGCAAACAATGTATACAAATGTACCAGAAGGAACATACGACATATC
CGCATTTCCAAAGAATGATTTCGTATCTTTCTGGGTTAAATTTGAACAAGGCGATTATAAAGTGGAAGAGTA
TTGTACGGGACTATGCGTCGAAGTAAAAATTGGACCACCGACTGTAACATTGACTGAATACGACGACCATA
TCAATTTGTACATCGAGCATCCGTATGCTACTAGAGGTAGCAAAAAGATTCCTATTTACAAACGCGGTGACA
TGTGTGATATCTACTTGTTGTATACGGCTAACTTCACATTCGGAGATTCTAAAGAACCAGTACCATATGATATC
GATGACTACGATTGCACGTCTACAGGTTGCAGCATAGACTTTGTCACAACAGAAAAAGTGTGCGTGACAG
CACAGGGAGCCACAGAAGGGTTTCTCGAAAAAATTACTCCATGGAGTTCGAAAGTATGTCTGACACCTAA
AAAGAGTGTATATACATGCGCAATTAGATCCAAAGAAGATGTTCCCAATTTCAAGGACAAAATGGCCAGAG
TTATCAAGAGAAAATTTAATAAACAGTCTCAATCTTATTTAACTAAATTTCTCGGTAGCACATCAAATGATGTT
ACCACTTTTCTTAGCATGCTTAACTTGACTAAATATTCATAACTAATTTTTATTAATGATACAAAAACGAAATA
AAACTGCATATTATACACTGGTTAACGCCCTTATAGGCTCTAACCATTTTCAAGATGAGGTCCCTGATTATAG
TCCTTCTGTTCCCCTCTATCATCTACTCCATGTCTATTAGACGATGTGAGAAGACTGAAGAGGAAACATGGG
GATTGAAAATAGGGTTGTGTATAATTGCCAAAGATTTCTATCCCGAAAGAACTGATTGCAGTGTTCATCTCC
CAACTGCAAGTGAAGGATTGATAACTGAAGGCAATGGATTCAGGGATATACGAAACACCGATAAATTATAA
AAAAAGCAATGTGTCCGCTGTTTCCGTTAATAATACTATTTTCGTAACTGGCGGATTATTCATAAATAACTCTA

<div align="center">FIG.15BA</div>

```
ATAGCACGATCGTGGTTAACAATATGGAAAAACTTGACATTTATAAAGACAAACAATGGTCGATTATAGAAA
TGCCTATGGCTAGGGTATATCACGGCATCGACTCGACATTTGGAATGTTATATTTTGCCGGAGGTCTATCCGT
TACCGAACAATATGGTAATTTAGAGAAAAACAACGAGATATCTTGTTACAATCCTAGAACGAATAAGTGGTT
TGATATTTCATATACTATTTATAAGATATCCATATCATCATTGTGTAAACTAAATAACGTCTTCTATGTATTTAGTA
AGGACATTGGATATGTGGAAAAGTATGATGGTGCATGGAAGTTAGTACATGATCGTCTCCCCGCTATAAAG
GCATTATCAACTTCTCCTTATTGATTGAAAATGAAAATATAAATAGTTTTTATGTATAGCAGTATTACCCTATAG
TTTTATTGCTTACTACTAACATGGATACAGATGTTACAAATGTAGAAGATATCATAAATGAAATAGATAGAGA
GAAAGAAGAAATACTAAAAAATGTAGAAATTGAAAATAATAAAAACATTAACAAGAATCATCCAAGTGGAT
ATATTAGAGAAGCACTCGTTATTAATACAAGTAGTAATAGTGATTCCATTGATAAAGAAGTTATAGAATGTAT
CAGTCACGATGTAGGAATATAGATCATATCTACTAATTTTTATAATCGATACAAAACATAAAAAACAACTCGTT
ATTACATAGCAGGCATGGAATCCTTCAAGTATTGTTTTGATAACGATGGCAAGAAATGGATTATCGGAAATA
CTTTATATTCTGGTAATTCAATACTATATAAGGTCAGAAAAAATTTCACTAGTTCGTTCTACAATTACGTAATG
AAAATAGATCACAAATCACACAAGCCATTGTTGTCTGAAATACGATTCTATATATCTGTATTGGATCCTTTGAC
TATCGACAACTGGACACGGGAACGTGGTATAAAGTATTTGGCTATTCCAGATCTGTATGGAATTGGAGAAA
CCGATGATTATATGTTCTTCGTTATAAAGAATTCGGGAAGAGTATTCGCCCCAAAGGATACTGAATCAGTCTT
CGAAGCATGCGTCACTATGATAAACACGTTAGAGTTTATACACTCTCGAGGATTTACCCATGGAAAAATAGA
ACCGAGGAATATACTGATTAGAAATAAACGTCTTTCACTAATTGACTATTCTAGAACTAACAAACTATACAAG
AGTGGAAACTCACATATAGATTACAACGAGGACATGATAACTTCAGGAAATATCAATTATATGTGTGTAGAC
AATCATCTTGGAGCAACAGTTTCAAAACGAGGAGATTTAGAAATGTTGGGATATTGCATGATAGAATGGTT
CGGTGGCAAACTTCCATGGAAAAACGAAAGTAGTATAAAAGTAATAAAACAAAAAAAAGAATATAAAAAA
TTTATAGCTACTTTCTTTGAGGACTGTTTTCCTGAAGGAAATGAACCTCTGGAATTAGTTAGATATATAGAAT
TAGTATACACGTTAGATTATTCTCAAACTCCTAATTATGACAGACTACGTAAACTGTTTATACAAGATTGAAAT
TATATTCTTTTTTTATAGAGTGTGGTAGTGTTACGGATATCTAATATTAATATTAGACTATCTCTATCGCGCTACA
CGACCAATATCGATTACTATGGATATCTTCAGGGAAATCGCATCTTCTATGAAAGGAGAGAATGTATTCATTT
CTCCAGCGTCAATCTCGTCAGTATTGACAATACTGTATTATGGAGCTAATGGATCCACTGCTGAACAGCTATC
AAAATATGTAGAAACGGAGGAGAACACGGATAAGGTTAGCGCTCAGAATATCTCATTCAAATCCATGAATA
AAGTATATGGGCGATATTCTGCCGTGTTTAAAGATTCCTTTTTGAGAAAAATTGGCGATAAGTTTCAAACTG
TTGACTTCACTGATTGTCGCACTATAGATGCAATCAACAAGTGTGTAGATATCTTTACTGAGGGGAAAATCA
ATCCACTATTGGATGAACCATTGTCTCCTGATACCTGTCTCCTAGCAATTAGTGCCGTATACTTTAAAGCAAA
ATGGTTGATGCCATTCGAAAAGGAATTTACCAGTGATTATCCCTTTTACGTATCTCCGACGGAAATGGTAGA
TGTAAGTATGATGTCTATGTACGGCAAGGCATTTAATCACGCATCTGTAAAGGAATCATTCGGCAACTTTTCA
ATCATAGAACTGCCATATGTTGGAGATACTAGTATGATGGTCATTCTTCCAGACAAGATTGATGGATTAGAAT
CCATAGAACAAAATCTAACAGATACAAATTTTAAGAAATGGTGTAACTCTCTGGAAGCTACGTTTATCGATG
TTCACATTCCCAAGTTTAAGGTAACAGGTTCGTATAATCTTGTGGATACTCTAGTAAAGTCAGGACTGACAG
AGGTGTTCGGTTCAACTGGAGATTATAGCAATATGTGTAATTCAGATGTGAGTGTCGACGCTATGATTCACA
AAACGTATATAGATGTCAATGAAGAGTATACAGAAGCAGCTGCAGCAACTTGTGCACTGGTGTCAGACTGT
GCATCAACAATTACAAATGAGTTCTGTGTAGATCATCCGTTCATCTATGTGATTAGGCATGTTGATGGAAAAA
TTCTTTTCGTTGGTAGATATTGCTCTCCGACAACTAATTGTTAACCATTTTTTTAAAAAAATAGAAAAAACAT
GTGGTATTAGTGCAGGTCGTTGTTCTTCCAATTGCAATTGGTAAGATGACGGCCAACTTTAGTACCCACGTC
TTTTCACCACAGCACTGTGGATGTGACAGACTGACCAGTATTGATGACGTCAGACAATGTTTGACTGAATAT
ATTTATTGGTCGTCCTATGCATACCGCAACAGGCAATGCGCTGGACAGTTGTATTCCACACTCCTCTCTTTTA
GAGATGATGCGGAATCAGTGTTCATCGACATTCGCGAGCTGGTAAAAAATATGCCGTGGGATGATGTCAAA
GATTGTACAGAAATCATCCGTTGTTATATACCGGATGAGCAAAAAACCATCAGAGAGATTTCGGCCATCATC
GGACTTTGTGCATATGCTGCTACTTACTGGGGAGGTGAAGACCATCCCACTAGTAACAGTCTGAACGCATT
```

<div align="center">FIG.15BB</div>

GTTTGTGATGCTTGAGATGCTCAATTACGTGGATTATAACATCATATTCCGGCGTATGAATTGATGAGTTGTA
CATCTTGACATTTTCTTTCTTCTCTTCTCCCTTTCTTCTCTTCTCCCTTCCTCCCTCTTCTCCCTTTCCCAGAAA
CAAACTTTTTTACCCACTATAAAATAAAATGAGTATACTACCTATTATATTTCTTCCTATATTTTTTTATTCTTCAT
TCGTTCAGACTTTTAACGCGCCTGAATGTATCGACAAAGGGCAATATTTTGCATCATTCATGGAGTTAGAAA
ACGAGCCAGTAATCTTACCATGTCCTCAAATAAATACGCTATCATCCGGATATAATATATTAGATATTTTATGGG
AAAAACGAGGAGCGGATAATGATAGAATTATACCGATAGATAATGGTAGCAATATGCTAATTCTGAACCCGA
CACAATCAGACTCTGGTATTTATATATGCATTACCACGAACGAAACCTACTGTGACATGATGTCGTTAAATTT
GACAATCGTGTCTGTCTCAGAATCAAATATAGATCTTATCTCGTATCCACAAATAGTAAATGAGAGATCTACT
GGCGAAATGGTATGTCCCAATATTAATGCATTTATTGCTAGTAACGTAAACGCAGATATTATATGGAGCGGAC
ATCGACGCCTTAGAAATAAGAGACTTAAACAACGGACACCTGGAATTATTACCATAGAAGATGTTAGAAAA
AATGATGCTGGTTATTATACATGTGTTTTAGAATATATATACAGAGGTAAAACATATAACGTAACCAGAATTGT
AAAATTAGAGGTACGGGATAAAATAATACCTTCTACTATGCAATTACCAGATGGCATTGTAACTTCAATAGGT
AGTAATTTGACTATTGCGTGTAGAGTATCGTTGAGACCTCCCACAACGGATGCAGACGTCTTTTGGATAAGT
AATGGTATGTATTACGAAGAAGATGATGGGGACGGAGACGGTAGAATAAGTGTAGCAAATAAAATCTATAT
GACCGATAAGAGACGTGTTATTACATCCCGGTTAAACATTAATCCTGTCAAGGAAGAAGATGCTACAACGT
TTACGTGTATGGCGTTTACTATTCCTAGCATCAGCAAAACAGTTACTGTTAGTATAACGTGAATGTATGTTGT
TACATTTCCATGTCAATTGAGTTTATAAGAATTTTATACATTATCTTCCAACAAACAATTGACGAACGTATTGC
TATGATTAACTCCCACGATACTATGCATATTATTAATCATTAACTTGCAGACTATACCTAGTGCTATTTTGACAT
ACTCATGTTCTTGTGTAATTGCGGTATCTATATTATTAAAGTACGTAAATCTAGCTATAGTTTTATTATTTAATTT
TAGATAATATACCGTCTCCTTATTTTTAAAAATTGCCACATCCTTTATTAAATCATGAATGGGAATTTCTATGTC
ATCGTTAGTATATTGTGAACAACAAGAGCAGATATCTATAGGAAAGGGTGGAATGCGATACATTGATCTATG
TAGTTTTAAAACACACGCGAACTTTGAAGAATTTATATAAATCATTCCATCGATACATCCTTCTATGTTGACAT
GTATATATCCAGGAATTCTTTTATTAATGTCAGGAAATGTATAAACTAAAACATTGCCCGAAAGCGGTGCCTC
TATCTGCGTTATATCCGTTCTTAACTTACAAAATGTAACCAATACCTTTGCATGACTTGTTTTGTTCGGCAACG
TTAGTTTAAACTTGACGAATGGATTAATTACAATAGCATGATCCGCGCATCTATTAAGTTTTTTTACTTTAACG
CCCTTGTATGTTTTTACAGAGACTTTATCTAAATTTCTAGTACTTGTATGTGTTATAAATATAACGGGATATAGA
ACTGAATCACCTACCTTAGATACCCAATTACATTTTATCAGATCCAGATAATAAACAAATTTTGTCGCCCTAAC
TAATTCTATATTGTTATATATTTTACAATTGGTTATGATATCATGTAATAACTTGGAGTCTAACGCGCATCGTCG
TACGTTTATACAATTGTGATTTAGTGTAGTATATCTACACATGTATTTTTCCGCACTATAGTATTCTGGACTAGT
GATAAAACTATCGTTATATCTGTCTTCAATGAACTCATCGAGATATTGCTCTCTGTCATATTCATACACCTGCAT
AAACTTTCTAGACATCTTACAATCCGTGTTATTTTAGGATCATATTTACATATTTACGGGTATATCAAAGATGTT
AGATTAGTTAATGGGAATCGTCTATAATAATGAATATTAAACAATTATATGAGGACTTTTACCACAAAGCATC
ATAAAAATGAGTCGTCGTCTGATTTATGTTTTAAATATCAACCGCAAATCAACTCATAAAATACAAGAGAATG
AAATATATACATATTTTAGTCATTGCAATATAGACCATACTTCTACAGAACTTGATTTTGTAGTTAAAAACTATG
ATCTAAACAGACGACAACATGTAACTGGGTATACTGCACTACACTGCTATTTGTATAATAATTACTTTACAAA
CGATGTACTGAAGATATTATTAAATCATGACGTAAATGTAACGATGAAAACCAGTAGCGGACGTATGCCTGT
TTATATATTGCTTACTAGATGTTGCAATATTTCACATGATGTAGTGATAGATATGATAGACAAAGATAAAAACC
ACTTATTACATAGAGACTATTCCAACCTATTACTAGAGTATATAAAATCTCGTTACATGTTATTAAAGGAAGAG
GATATCGATGAGAACATAGTATCCACTTTATTAGATAAGGGAATCGATCCTAACTTTAAACAAGACGGATATA
CAGCGTTACATTATTATTATTTGTGTCTCGCACACGTTTATAAACCAGGTGAGTGTAGAAAACCGATAACGAT
AAAAAAGGCCAAGCGAATTATTTCTTTGTTTATACAACATGGAGCTAATCTAAACGCGTTAGATAATTGTGG
TAATACACCATTCCATTTGTATCTTAGTATTGAAATGTGTAATAATATTCATATGACTAAAATGCTGTTGACTTT
TAATCCGAATTTCAAAATATGTAATAATCATGGATTAACGCCTATACTATGTTATATAACTTCCGACTACATACA
ACACGATATTCTTGTTATGTTAATACATCACTATGAAACAAATGTTGGAGAAATGCCGATAGATGAGCGTCGT

*FIG.15BC*

```
ATGATCGTATTCGAGTTTATCAAAACATATTCTACACGTCCGGCAGATTCGATAACTTATTTGATGAATAGGTT
TAAAAATATAAATATTTATACCCGCTATGAAGGAAAGACATTATTACACGTAGCATGTGAATATAATAATACAC
ACGTAATAGATTATCTTATACGTATCAACGGAGATATAAATGCGTTAACCGACAATAACAAACACGCTACACA
ACTCATTATAGATAACAAAGAAAATTCCCCGTATACCATCGATTGTTTACTGTATATACTTAGATATATTGTAGA
TAAGAATGTGATAAGATCGTTGGTGGATCAACTTCCATCTCTACCTATCTTCGATATAAAATCATTTGAGAAA
TTCATATCCTACTGTATACTTTTAGATGACACATTTTACGATAGGCACGTTAAGAATCGCGATTCTAAAACGTA
TCGATACGCATTTTCAAAATACATGTCGTTTGATAAATACGATGGTATAATAACTAAATGTCACGACGAAACA
ATGTTACTCAAACTGTCCACTGTTCTAGACACTACACTATATGCAGTTTTAAGATGCCATAATTCGAAAAAGT
TAAGAAGATACCTCAACGAGTTAAAAAAATATAATAACGATAAGTCCTTTAAAATATATTCTAATATTATGAAT
GAGAGATACCTTAATGTATATTATAAAGATATGTACGTGTCAAAGGTATATGATAAACTATTTCCTGTTTTCAC
AGATAAAAATTGTCTACTAACATTACTACCTTCAGAAATTATATACGAAATATTATACATGCTGACAATTAACG
ATCTTTATAATATATCGTATCCACCTACCAAAGTATAGTTGTATTTTTCTCATGCGATGTGTGTAAAAAAACTG
ATATTATATAAATATTTTAGTGCCGTATAATAAAGATGACGATGAAAATGATGGTACATATATATTTCGTATCATT
ATTGTTATTGCTATTCCACAGTTACGCCATAGACATCGAAAATGAAATCACAGAATTCTTCAATAAAATGAGA
GATACTCTACCAGCTAAAGACTCTAAATGGTTGAATCCAGCATGTATGTTCGGAGGCACAATGAATGATATA
GCCGCTCTAGGAGAGCCATTCAGCGCAAAGTGTCCTCCTATTGAAGACAGTCTTTTATCGCACAGATATAAA
GACTATGTGGTTAAATGGGAGAGGCTAGAAAAGAATAGACGGCGACAGGTTTCTAATAAACGTGTTAAAC
ATGGTGATTTATGGATAGCCAACTATACATCTAAATTCAGTAACCGTAGGTATTTGTGTACCGTAACTACAAA
GAATGGTGACTGTGTTCAGGGTATAGTTAGATCTCATATTAAAAAACCTCCTTCATGCATTCCAAAAACATAT
GAACTAGGTACTCATGATAAGTATGGCATAGACTTATACTGTGGAATTCTTTACGCAAAACATTATAATAATAT
AACTTGGTATAAAGATAATAAGGAAATTAATATCGACGACATTAAGTATTCACAAACGGGAAAGAAATTAAT
TATTCATAATCCAGAGTTAGAAGATAGTGGAAGATACAACTGTTACGTTCATTACGACGACGTTAGAATCAA
GAATGATATCGTAGTATCAAGATGTAAAATACTTACGGTTATACCGTCGCAAGACCACAGGTTTAAACTAATA
CTAGATCCAAAAATCAACGTAACGATAGGAGAACCTGCCAATATAACATGCACTGCTGTGTCAACGTCATTA
TTGATTGACGATGTACTGATTGAATGGGAAAATCCATCCGGATGGCTTATAGGATTCGATTTTGATGTATACT
CTGTTTTAACTAGTAGAGGCGGTATTACCGAGGCGACCTTGTACTTTGAAAATGTTACTGAAGAATATATAG
GTAATACATATAAATGTCGTGGACACAACTATTATTTTGAAAAAAACCCTTACAACTACAGTAGTATTGGAGTA
AATACACAATGCATTTTTATATACATTACTGAATAATTATTATTATTATTTATATCGTATTTGTGCTATAACGCGA
CTATCTAGGTATTTGTATCTCACTGATAGAGAACATATAAATATAGACTCTATTAAACAGTTGTGTAAAATATCA
AATCCTAATAGATGTGGATGTACGGCTTTACATGAGTACTTTTATAATTATAGATCAGTCAACGGAAAATACA
AGTATAGATACAACGGTTACTATCAATATTATTTATCTAGCGATTATGAAAATTATAATGAATATTATTATGATGA
TTATGATAGAACTGGTATGAACAGTGAGAGTGATAATATATCAATCAAAACAGAATATGAATTCTATGATGAA
ACACAAGATCAAAGTACACAACTAGTAGGTTACGACATTAAACTCAAAACCAATGAGGATGATTTATGGC
TATGATAGATCAGTGGGTGTCCATGATTATATAGATGAATCAATTAATAAAGTAGTATATGGAAGAGAGTCTC
ACGTAAGATGGCGGGATATATGGCAAGAACATAATGATGGCGTATACAGTATAGGAAAGGAGTGCATAGAT
AATATATACGAAGACAACCATACCGTAGACGAATTCTACAAGATAGACAGCGTATCAGATGTAGATGACGCG
GAACACATATCTCCGATAACTAATGATGTATCTACACAAACATGGGAAAAGAAATCAGAGTTAGATAGATAC
ATGGAAATGTATCCTCGTCATAGATATAGTAAGCATTCTGTCTTTAAGGGATTTTCTGACAAAGTTAGAAAAA
ATGATTTAGACATGAATGTGGTAAAAGAATTACTTTCTAACGGTGCATCTCTAACAATTAAGGATAGCAGTA
ATAAGGATCCAATAACCGTTTATTTTCGAAGAACGATAATGAATTTAGAAATGATTGATATTATTAACAAACA
TACAACTATTGATGAACGAAAGTATATAGTACACTCCTATCTAAAAAATTATAAAAATTTCGATTATCCATTTTT
CAGGAAGTTAGTTTTGACTAATAAACATTGTCTCAACAATTATTATAATATAAGCGACAGCAAATATGGAACA
CCGCTACATATATTGGCGTCTAATAAAAATTAATAACTCCTAATTACATGAAGTTATTAGTGTATAACGGAAAT
GATATAAACGCACGAGGTGAAGATACACAAATGCGAACTCCATTACACAAATATTTGTGTAAATTTGTATATC
```

<p style="text-align:center"><em>FIG.15BD</em></p>

```
ATAATATTGAATATGGTATCCGATACTATAATGAAAAGATTATAGACGCATTTATAGAGTTAGGAGCCGATCTA
ACTATTCCAAATAACGATGGAATGATACCAGTAGTTTACTGTATACACTCAAATGCAGAATATGGTTATAACA
ATATTACTAACATAAAGATAATACGTAAACTACTTAATCTTAGTAGACGTGCGTCACATAATCTATTTAGAGAT
CGAGTCATGCACGATTATATAAGTAATACATATATTGATCTTGAGTGTTTAGATATTATTAGATCGTTGGATGG
ATTCGATATCAATGGTTACTTTGAAGGACGTACACCACTTCATTGCGCTATACAACATAACTTCACTCAGATT
GCTAAGTACTTATTAGATCGAGGAGCTGATATAGTCGTACCCAACACATTGATTATACATCAGTACATACAGT
AAATAGCATAGATATGGAGGAGGATACAAATATTTCAAATAAAGTTATAAGGTACAACACTGTCAATAATATA
TGGAAGACATTACCTAACTTCTGGACTGGAACTATAAATCCAGGCGTGGTCTCGCATAAAGATGATATATAT
GTTGTATGCGACATCAAAGATGAAAAAAATGTTAAGACTTGTATATTTAGATATAACACGAATACGTATAACG
GATGGGAATTGGTTACGACGACAGAAAGCAGATTATCAGCTCTGCATACTATTCTTCATGACAATACCATAA
TGATGTTACATTGTTATGAATCGTATATGTTACAAGATACATTTAATGTGTACACTCGCGAATGGAATCATATG
TGTCATCAACATTCGAATAGTTATATCATGTACAATATACTACCCATCTACTAAATATAATAGAATAAAATAAAT
GAGTATGATCATTTTAGATAACGATTGATTTTATCATTACCGCTTCATTCTTATATTCTTTGCTTACGGAACCTA
TATTTAGAAACATCTACTAACGATTTTTTATGCTTGCATTATTAATGGTATGTAATATGATTGATTGTGTACGCA
ATACCAATTTGTTAAGTATGAATACGGGGTACAAACATAAACTGAAATTTAACATTATTTATTTATGATATATAT
CGTTATCGTTATTGTTTGGTCTATACCATGGATATCTTTAAAGAACTAATCTTAAAACACCCTGATGAAAATGT
TTTGATTTCTCCAGTTTCTATTTTATCTACTTTATCTATTCTAAATCATGGAGCAGCTGGTTCTACAGCTGAAC
AACTATCAAAATATATAGAGAATATGAATGAGAATACACCCGATGATAAGAAGGATGACAATAATGACATGG
ACGTAGATATTCCGTATTGTGCGACACTAGCTACCGCAAATAAAATATACGGTAGCGATAGTATCGAGTTCCA
CGCCTCCTTCCTACAAAAAATAAAAGACGATTTTCAAACTGTAAACTTTAATAATGCTAACCAAACAAAGGA
ACTAATCAACGAATGGGTTAAGACGATGACAAATGGTAAAATTAATTCCTTATTGACTAGTCCGCTATCCATT
AATACTCGTATGACAGTTGTTAGCGCCGTCCATTTTAAAGCAATGTGGAAATATCCATTTTCTAAACATCTTA
CATATACAGACAAGTTTTATATTTCTAAGAATATAGTTACCAGTGTTGATATGATGGTGGGTACCGAGAATAA
CTTGCAATATGTACATATTAATGAATTATTCGGAGGATTCTCTATTATCGATATTCCATACGAGGGAAACTCTA
GTATGGTAATTATACTACCGGACGACATAGAAGGTATATATAACATAGAAAAAAATATAACAGATGAAAAATT
TAAAAAATGGTGTGGTATGTTATCTACTAAAAGTATAGACTTGTATATGCCAAAGTTTAAAGTGGAAATGAC
AGAACCGTATAATCTGGTACCGATTTTAGAAAATTTAGGACTTACTAATATATTCGGATATTATGCAGATTTTA
GCAAGATGTGTAATGAAACTATCACTGTAGAAAAATTTCTACATACGACGTTTATAGATGTTAATGAGGAGT
ATACAGAAGCATCGGCCGTTACAGGAGTATTTATGACTAACTTTTCGATGGTATATCGTACGAAGGTCTACAT
AAAACCATCCATTCATGTACATGATTAAAGACAACACAGGACGTATACTTTTTATAGGGAAATACTGCTATCCG
CAATAAATATAAACAAATAGACTTTTATCACGTTTATCTATGTCTAAATATTACAAATAGTAATAGTATAAACTA
AAGCTGATAATACTTAAAAAATAATAATATCATTTACAATTAATAGTATAAACTAAAAATTAAACAAATCGTTAT
TATAAGTAATATCAAAATGATGATATACGGATTAATAGCGTGTCTTATATTCGTGACTTCATCCATCGCTAGTCC
ACTTTATATTCCCGTTATTCCACCCATTACGGAAGATAAATCGTTCAATAGTGTAGAGGTATTAGTTTCCTTGT
TTAGAGATGACCAAAAGACTATACGGTAACTTCTCAGTTCAATAACTACACTATCGATACCAAAGACTGGA
CTATCGGCGTACTATCCACACCTGATGGTTTGGATATACCATTGACTAATATAACTTATTGGTCACGGTTTACT
ATAGGTCGTGCATTGTTCAAATCAGAGTCTGAGGATATTTTCCAAAAGAAAATGAGTATTCTAGGTGTTTCT
ATAGAATGTAAGAAGTCGTCGACATTACTTACTTTTTTGACCGTGCGTAAAATGACTCGAGTATTTAATAAAT
TTCCAGATATGGCTTATTATCGAGGAGACTGTTTAAAAGCCGTTTATGTAACAATGACTTATAAAAATACTAA
AACTGGAGAGACTGATTACACGTACCTCTCTAATGGGGGGTTGCCTGCATACTATCGTAATGGGGTCGATG
GTTGATTATTGATTAGTATATTCCTTATTCACACAAAAGAACATTTTTATAAACATGAAACCACTGTCTAAAT
GTAATTATGATCTTGATTTATAGATGAAGATCAGCCTTTAGAGGATTTTAACCAGTATGTTTAATATGAAAAA
AATAAACATAACATATTTTGAGATTAAGCGCTATTGTGCTTAATTATTTTGCTCTATAAACTGAATATATAGCCA
CAATTATTGACGGGCTTGTTTATGACCGGCAATCATGAATTTACAGAAATTATCTCTGGCTATATATCTTACTG
```

<div align="center">FIG.15BE</div>

CGACATGTTCGTGGTGTTATGAAACATGCATAAGAAAAACTGCGTTGTATCATGACATTCAATTGGAGCATG
TAGAAGACAATAAAGATAGTGTAGCGTCGCTACCGTACAAGTAGTCAATCAAAGAGAACGTAGTAGATTGT
TGGCTACATTTAATTGGACAGATATAGCTGAGGGTGTTAGAAATGAGTTCATTAAAATATGTGATATCAACG
GAACATATTTATATAATTATACTATTGCTGTTAGTATAATTATTGATTCCACGGAAGAACTACCAACAGTTACTC
CAATTACAACAACATATGAACCTTCTACATATAATTATACTATCGATGATAGCACTGTTATTACTACTGAAGAA
CTACAAGTGACTCCTCATATGGATCTCCATCGATGATACATGTATTAAAATACTTTCCGAATAAGTCTTTTAAA
TATTGTATTAATTATGAAAAACTATGCTATGCGAGTATGATGCAAAGATGTTTAATGATACGATACTAGATTTT
ATCTCTAGCGAGAGATGTCGTTAGAATCATTTATCATAACTACGTTTAATAATAATTCATCAACGAATATCGAT
AACATGTGTCATTTATACGTTAAAGTCTGTCCGTCTTCTCTATTGTTTAGACTGTTTGTAGAATGCTGTGATAT
AAACAAACTAGTAGAAGGTACGACTCCGTTACACTGTTATCTAATGAATGAAGGATTTGAATCATCTGTTTT
AAAAAACCTATTAAAGGAGTATGTCATGAATACGTTTAATGTTCATGACATCCATTACACAAATATTTAACTC
ATGATGAAGTTGAGAATGATATGCTTTCTGATAGTATAGATAGCTTTAGCTAATATAAAAATATATTAATCCAC
TATATATTCTAGACTTGATTTAAAACCGATAAACTACTACTACGTACTGTATAAGTTGTTAAAAAAAGGAGCA
GACCCTAATTATGTAGATGATAGAGGTAATACTTTTCTTCATTACTTCTGCATCTATATGTCCACTTATGAGAA
AACGTCATTTAATAAGATGCATCGTGAAAAGAAATTTATTAAAGAGTTGGTAAAATATGAAACCGAAAGTAA
ATAATATAGGAAATACACCTCTACATAACTACGTATCTCAATATGATATCACTCTCATTCCTCATCCACAACCCA
TTAAAAAAATGGAAATTAAAGCCCTCTATTAGCATAAACGGCTACAGGTCTACCTTTACAATGGCCTCTCCTT
GTGCCCAGTTCAGACCCTGTCATTGCCACGCTACTAAGGACTCCCTGAATACCGTGGCCGACGTCAGACAT
TGTCTGACTGAATACATCCTGTGGGTTTCTCATAGATGGACCCATAGAGAAAGCGCAGGGTCTCTCTACAG
GCTTCTCATCTCTTTCAGAACTGATGCAACGGAGCTCTTTGGTGGTGAGTTGAAGGATTCACTTCCGTGGG
ACAATATCGACAATTGCGTGGAGATCATTAAATGTTTCATCAGAAATGACTCCATGAAAACCGCCGAAGAA
CTTCGTGCAATCATTGGACTTTGTACTCAATCAGCTATCGTCTCTGGAAGAGTCTTCAACGATAAGTATATCG
ACATACTACTTATGCTGCGAAAGATTCTGAACGAGAACGACTATCTCACCCTCTTGGATCATATCCGCACTGC
TAAATACTAAATCTCCTTCATGCTCTCTCACTACACTTTTTATCATCTTATGAGGAATGATTGCCTTCATCATTT
TTCGTGAAATAGGAATAATTAGCACCAGAATAGCTATGGATTGCACATGTATTCTATGTCGTCTACTGGATGA
AGATGTGACGTACAAAAAAATAAAACTAGAAATTGAAACGTGTCACAACTTATCAAAACATATAGATAGAC
GAGGAAACAATGCGCTACATTGTTACGTCTTCAATAAATGCGATACAGACATTAAGATTGTTCGACTGTTAC
TCTCTCGCGGAGTCGAGAGACTTTGTAGAAACAACGAAGGATTAACTCCGCTAGGAGCATACAGTAAGCA
TAGATACGTAAAATCTCAAATTGTGCATCTACTGATATCCAGCTATTCGAATTCCTCTAACGAACTCAAGTCG
AATATAAATGATTTCGATCTGTATTCGTATATGTCTTCGGATAATATCGACTTACGTCTGCTAAAATACCTAATT
GTGGATAAACGGATACGTCCGTCCAAGAATACGAATTATGCAATCAATGGTCTCGGATTGGTGGATATATAC
GTAACGACGCCTAATCCGAGACCAGAAGTATTGCTATGGCTTCTTAAATCAGAATGTTACAGCACCGGTTAC
GTATTTCGTACCTGTATGTACGACAGTGATATGTGTAAGAACTCTCTTCATTACTATATATCGTCTCATAGAGA
ATCTCAATCTCTATCCAAGGATGTAATTAAATGTTTGATCAATAACAATGTTTCCATCCATGGCAGAGACGAA
GGAGGATCTTTACCCATCCAATACTACTGGTCTTGCTCAACCATAGATATAGAGATTGTTAAATTATTAATAAA
GGATGTGGACACGTGTAGAGTATACGACGTCAGCCCTATATTAGAGGCGGATTATCTAAACAAGCGATTTA
GAGTAACCCCATATAATGTAGACATGGAAATCGTTAATCTTCTTATTGAGAGACGTCATACTCTTGTCGACGT
AATGCGTAGTATTACTTCTTACGATTCCAGAGACTATAACCACTACATCATCGATAACATTCTAAAGAGATTTA
GACAACAGGATGAATCCATCGTACAAGCCATGTTGATAAACTACTTACATTACGGCGATATGGTCGTTCGAT
GCATGTTAGATAACGGACAACAACTATCCTCTGCACGACTACTTTGTTAATAATAATCTCGTCGATGTAAACG
TCGTAAGGTTTATCGTGGAAAATAATGGACACATGGCTGTAAATCACGTATCGAACAATGGCCGTCTATGTA
TGTACGGTCTGATATTATCGAGATTTAATAATTGCGGGTATCACTGTTATGAAACCATACTAATAGATGTATTT
GATATACTAAGCAAGTACATGGATAATATAGATATGATCGATAATGAGAATAAAACTCTACTATATTACGCGGT
CGATGTCAATAATATACAATTTGCAAAGCGGTTATTGGAATATGGAGCGAGTGTTACAACATCACGCTCGAT

<div style="text-align:center">*FIG.15BF*</div>

AATCAATACGGCCATCCAGAAAAGTAGTTACAGAAGAGAAAACAAAACGAGGATAGTTGATTTATTACTTA
GCTACCATCCCACTCTAGAGACTATGATTGACGCATTTAATAGAGATATACGCTATCTATATCCTGAACCATTA
TTCGCCTGTATCAGATACGCCTTAATCCTAGATGATGATTTTCCTTCTAAAGTAAGTATGATATCTCCGGTCGT
CATAAGGAACTAAAGCGCTATAGAGTAGACATTAATAGAATGAAGAATGCCTACATATCAGGCGTCTCCATG
TTTGATATATTATTTAAACGAAGCAAACGCCACAGATTGAGATACGCAAAGAATCCGACATCAAATGGTACA
AAAAAGAACTAACGTCCATCATTACAGAAACTGTAAAGAACAATGAGAGGATCGACTCCATAGTGGACAA
CATTAATACAGACGATAACTTGATTTCGAAATTACCCATGGAGATACTTTATTACTCCATTAAATAATTTATCAT
GGAGCGATAATGTCCTGTTTCATTTGTTTCCATGACATATTACAAAATCGATTCCGTCCAAGATGATAAAAAC
ATTTACCG
GCATCATAAACACGGAGTTTATTTTATATGTCTCGCATAAACATTACTAAAAAAATATATTGTTCGGTTTTCTT
TCACATCTTTAATTATGAAAAAGTAAATCATTATGAGATGGACGAGATTGTACGCATCGTTCGCGACAGTATG
TGGTACATACCTAACGTATTTATGGACGACGGTAAGAATGAAGGTCACGTTTCTGTCAACAATGTTTGTCAT
ATGTATTTTACGTTCTTTGATGTGGATACATCGTCTCATCTGTTTAAGCTAGTTATTAAACACTGCGATCTGAA
TAAACGAGGTAACTCTCCATTACATTGCTATACGATGAATACACGATTTAATCCATCTGTATTAAAGATATTGT
TACACCACGGCATGCGTAACTTTGATAGCAAGGATGAAAAAGGACATATTCCTCTACACCACTATCTGATTC
ATTCACTATCAATCGATAACAAGATCTTTGATATACTAACGGACACCATTGATGACTTTAGTAAATCATCCGAT
CTATTGCTGTGTTATCTTAGATATAAATTCAATGGGAGCTTAAACTATTACGTTCTGTACAAAGGATCCGACC
CTAATTGCGTCGACGAGGATGGACTCACTTCTCTTCATTACTACTGTAAACACATATCCACGTTCTACAAAAG
CAATTATTACAAGTTAAGTCACACTAAGATGCGAGCCGAGAAGCGATTCATCTACGCGATAATAGATTATGG
AGCAAACATTAACGCGGTTACACACTTACCTTCAACAGTATACCAAACATAGTCCTCGTGTGGTGTATGCTC
TTTTATCTCGAGGAGCCGATACGAGGATACGTAATAATCTTGATTGTACACCCATCATGGAACGATTGTGCA
ACAGGTCATATTCTCATAATGTTACTCAATTGGCACGAACAAAAGGAAGAAGGACAACATCTACTTTATCTA
TTCATAAAACATAATCAAGGATACACTCTCAATATACTACGGTATCTACTAGATAGGTTCGACATTCAGAAAG
ACGAATACTATAATACCGCCTTTCAAAATTGTAACAACAATGTTGCCTCATACATCGGATACGACATCAACCT
TCCGACTAAAGACGGTATTCGACTTGGTGTTTGAAAACAGAAACATCATATACAAGGCGGATGTTGTGAAT
GACATCATCCACCACAGACTGAAAGTATCTCTACCTATGATTAAATCGTTGTTCTACAAGATGTCTCTCCCTAC
GACGATTACTACGTAAAAAAGATACTAGCCTACTGCCTATTAAGGGACGAGTCATTCGCGGAACTACATAGT
AAATTCTGTTTAAACGAGGACTATAAAAGTGTATTTATGAAAAATATATCATTCGATAAGATAGATTCCATCAT
CGTGACATAAGTCGCCTTAAAGAGATTCGAATCTCCGACACCGACCTGTATACGGTATCACAGCTATCTTAA
AGCCATACATTCAGACAGTCACATTTCATTTCCCATGTACGACGATCTCAAACCCGTACCCAGAAATACCTTT
AACTATATCGATGTGGAAATTAATCTGTATCCCGTCAACGACACATCGTGTACTCGGACGACCACTACCGGT
CTCAGCGAATCCATCTCAACGTCGGAACTAACTATTACTATGAATCATAAAGACTGTAATCCCGTCTTTCGTG
ATGGATACTTCTCCGTTCTTAATAAGGTAGCAACTTCAGGATTCTTTACAGGAGAAAGGTGTGCACTCTGAA
TTTCGAGATTAAATGCAATAACAAAGATTCTTCCTCCAAACAGTTAACGAAAGCAAAGAATGATACTATCAT
GCCGCATTCGGAGACAGTAACTCTAGCGTCGACATCTATATACTATATAGTAATACCAATACTCAAGACTACG
AAACTGATACAATCTCTTATCATGTGGGTAATGTAGCCATATGCCCGGTAGTTGCGATATACATAAACTGATC
ACTAATTCCAAACCCACCCGCTTTTTATAGTAAGTTTTTCACCCATAAATACAATAATTAATTTCTCGTAAAAG
TAGAAAATATATTCTAATTTATTGCACGGTAAGGAAGTAGAATCATAAAGAACAGTACTCAATCAATAGCAAT
CATGAAACAATATATCGTACTGGCATGCATGTGCCTGCCAGTCTTCAGCAATCATCCTCATCGTGTACGGAA
GAAGAAAACAAACATCATATGGGAATCGATGTTATTATCAAAGTCACAAAGCAAGACCAAACACCGACCG
ATGATAAGATTTGCCAATCCGTAACGGAAATTACAGAGTCCGAGTCAGATCCAGATCCCGAGGTGGAATCA
GTCGAGGATGTAGATCCTCCTACCACTTATTACTCCATCATCGGTGGAGGTCTGAGAATGAACTTTGGATTC
ACCAAATGTCCTCAGATTAAATCCATCTCAGAATCCGCTGATGGAAAGACTGTGAGGTGTCTATCGACATCA
GATGTAGCGAAGAAGAGAAAGACAGCGACATCAAGACCCATCCAGTACTCGGGTCTAACATCTCTCATAA

<div style="text-align:center">*FIG.15BG*</div>

GAAAGTGAGTTACGAAGATATCATCGGTTCAACGATCGTCGATACAAAATGTGTCAAGAATCTAGAGTTTA
GCGTTCGTATCGGAGACATGTGCAAGGAATCATCTGAACTTGAGGTCAAGTATGTCGACGGATCGGCATCT
GAAGGTGCAACCGATGATACTTCACTCATCGATTCAACAAAACTCAAAGCGTGTGTCTGAATCGATAACTCT
ATTCATCTGAAATTGGATGAGTAGGGTTAATCGAACGATTCAGGCACACCACGAATTAAAAAAGTGTACCG
GACACTATATTCCGGTTTGCAAAACAAAAAGTTACCTCTCGCGACTTCTTCTTTTTCTGTCTCAATAGTGTGA
TACGATTATGACACTATTCCTATTTCCTTTCAGGGTATCACAAAAATATTAAACCTCTTTCTGATGGTCTCATA
AAAAAAGTTTTACAAAAATATTTTTTTATTCTCTTTCTCTCTTTGATGGTCTCATAAAAAAAGTTTTACAAAA
ATATTTTTATTCTCTTTCTCTCTTTGATGGTCTCATAAAAAAAGTTTTACAAAAATATTTTTATTCTCTTTCTCTC
TTTGATGGTCTCATAAAAAAAGTTTTACAAAAATATTTTTATTCTCTTTCTCTCTTTGATGGTCTCATAAAAAA
AGTTTTACAAAAATATTTTTATTCTCTTTCTCTCTTTGATGGTCTCATAAAAAAAGTTTTACAAAAATATTTTT
ATTCTCTTTCTCTCTTTGATGGTCTCATAAAAAATATTAAACCTCTTTCTGATGGTGTCACTAAAATATTTTTAT
TCTCATTCTCATTTTCTCTTTCTCTCTTCAATGGAGTCATAAAATATTTTTATTCTCTTTCTCTCTTCGATGGTCT
CACAAAAATATTAAACCTCTTTCTGATGGTGTCACTAAAATATTTTTATTCTCATTCTCATTTTCTCTTTCTCTC
TTCAATGGAGTCATAAAATATTTTTATTCTCTTTCTCTCTTCGATGGTCTCACAAAAATATTAAACCTCTTTCTG
ATGGAGTCGTAAAAAAGTTTTATCTCTTTCTCTCTTCGATGGTCTCACTAAAATATTTTTATTCTCTTTCTGAT
GCATCAACTATTTCTTAAACAATAACGTCCAACAACATATACTCGTCGAGCTTATCAACATCCCCTATGCCCAT
CTAGGTTACCAGACAATTGTATATCATAAAATAATGTTTATAATTTACACGTTAAAATCATATAATAAAACGTAG
ATCGTATAATATTTTTTGGTATATAAATGATCTAGTAAAATCCATGTAGGGGATACTGCTCACATTTTTTCTTTG
GTACAAAATTTCACACAAGTTTTTATACAGACAAATTCTTGTCCATATATTTTAAAACATTGACTTTTGTACTA
AGAAAAATATCTAGACTAACTATCTCTTTCTCTTTCTCTCTTCGATGGTCTCACAAAAATATTAAACCTCTTTC
TGATGGAGTCGTAAAAAAGTTTTATCTCTTTCTC

<div style="text-align:center">*FIG.15BH*</div>

1

METHODS COMPRISING ONCOLYTIC VIRUSES EXPRESSING CD19T AND BISPECIFIC T CELL ENGAGERS

CLAIM OF PRIORITY

This application claims the benefit of U.S. Provisional Application Ser. No. 63/596,582, filed on Nov. 6, 2023. The entire contents of the foregoing are incorporated herein by reference.

SEQUENCE LISTING

This application contains a Sequence Listing that has been submitted electronically as an XML filed named "40056-0103001_SL.xml." The XML file, created on Jan. 8, 2025 is 1,638,797 bytes in size. The material in the XML file is hereby incorporated by reference in its entirety.

TECHNICAL FIELD

This disclosure relates to methods of treating a subject having a solid tumor comprising administering an oncolytic virus expressing a truncated CD19 (CD19t), and a CD19-targeted therapy that binds to the CD19t (e.g., a bispecific T cell engager (TCE)).

BACKGROUND

A universal tumor-agnostic cancer therapy remains elusive in the field of immunotherapy. There have been impressive patient specific immunotherapies with recent FDA approvals including CAR T cell therapies. Limitations include the autologous nature of these cells and the length of time required to manufacturing. In contrast to autologous CAR T cells, the benefits of bispecific T cell engagers (called BiTEs and TCEs interchangeably herein) are its off-the-shelf availability and the ability to acutely tune targeting with dosing regimens [1, 2]. TCEs have emerged as a promising immunotherapy strategy for the treatment of B-cell hematological malignancies. Blinatumomab, an FDA approved TCE carrying CD19 and CD3 single chain variable fragments (scFvs) that drives endogenous T-cell mediated immune responses against malignant cells, has shown durable clinical responses for the treatment of B-cell acute lymphoblastic leukemia (B-ALL) and non-Hodgkin's lymphoma [3, 4].

Challenges facing solid tumor therapies using CAR T cells and TCE therapies are driven by a lack amenable and targetable tumor antigens [5, 6]. The shared expression of solid tumor antigens on normal tissue and their heterogeneous, and nonuniform, expression patterns on tumors limits the potential for effective and durable anti-tumor responses [7, 8]. Many solid tumors are also immunologically "cold" and limit T cell trafficking and anti-tumor functionality, a phenomenon uncommonly observed in hematological malignancies [9-11]. Further, the majority of solid tumors have a more complex microenvironment that represents a greater challenge for cancer therapies [24]. Thus, improved and more accessible immunotherapies remain to be explored.

SUMMARY

This application is based, at least in part, on the discovery that use of oncolytic viruses (OV) to redirect CD19-targeted bispecific T cell engagers (called BiTEs or TCEs interchangeably throughout) drives anti-tumor responses of endogenous T cells against multiple solid tumor types.

Chimeric antigen receptor (CAR)-engineered T cell therapies targeting CD19 demonstrate remarkable clinical successes for patients with hematological malignancies. However, limited and heterogeneously-expressed tumor targets impede the field in similarly treating solid tumors. This application is describes, inter alia, a combinatorial platform using OV and CD19-targeting BiTEs to target particularly difficult to treat solid tumors. Furthermore, this approach overcame the concerning issue of antigen escape following treatment with HER2-CAR T cells. Combining OV with clinically-approved TCEs as described herein provides a readily translatable, tumor-agnostic, off-the-shelf strategy to effectively target solid tumors.

OV have recently emerged as a promising off-the-shelf treatment modality for various tumor types. OV are tumor-specific viruses that have desirable immunogenic properties with the capacity for transgene delivery to tumors [12]. An OV (OV19t) expressing a truncated non-signaling variant of CD19 (CD19t) has been shown to redirect of CD19-CAR T cells to solid tumors by exploiting the transgene delivery potential of OV19t to selectively infect and drive tumor-specific expression of the truncated nonsignaling variant of CD19 [13]. The parent version of the chimeric poxvirus-based OV used here has shown safety and antitumor activity in several preclinical models [14,15]. Herein, we expand the therapy by making it fully off-the-shelf with the addition of a BiTEs. Here, the data demonstrate robust cell surface CD19t expression on multiple tumor types infected with an OV carrying the CD19t-encoding gene (OV19t) as described herein, which promoted activation and tumor killing by T cells when treated with a CD19-TCE.

Described herein, inter alia, are methods of administering an oncolytic virus (OV) expressing a truncated variant of CD19 (CD19t) and an agent that binds both CD19 and CD3 (e.g., a bispecific T cell engager) to a subject in need thereof. Described herein are methods of killing solid tumor cancer cells comprising: administering to the subject an effective amount of an oncolytic virus expressing CD19 or CD19t (OV19 or OV19t); and administering to the subject a bispecific T cell engager (TCE) that binds to the CD19 or CD19t encoded by the OV19 or OV19t. Also described herein are methods of treating a subject having a solid tumor comprising: administering to the subject an effective amount of an oncolytic virus expressing CD19 or CD19t (OV19 or OV19t); and administering to the subject a bispecific T cell engager (TCE) that binds to the CD19 or CD19t encoded by the OV19 or OV19t.

Described herein is a method of treating a subject having a solid tumor comprising: administering to the subject an effective amount of an oncolytic virus expressing a truncated CD19 (OV19t), the nucleotide sequence of OV19t comprising: (a) an oncolytic virus nucleotide sequence; and (b) a nucleotide sequence encoding a truncated human CD19; and administering to the subject an effective amount of a bispecific T cell engager (TCE) that binds to CD19.

In various embodiments: OV19t does not encode functional thymidine kinase; the OV19t comprises a nucleotide sequence that is at least 90%, 95%, 96%, 97%, 98%, 99%, 99.5%, 99.9% or 100% identical to SEQ ID NO: 1 over the entire length of SEQ ID NO: 1; the oncolytic virus nucleotide sequence comprises a nucleotide sequence that is at 90%, 95%, 96%, 97%, 98%, 99%, 99.5%, 99.9% or 100% identical to: a) SEQ ID NO: 2 over the entire length of SEQ ID NO: 2, but lacks the JR2 gene sequence of SEQ ID NO: 2; or b) SEQ ID NO: 2 over the entire length of SEQ ID NO:

2, but lacks JR2 gene sequence, the 5' ITR sequence and the 3' ITR sequence of SEQ ID NO: 2; the oncolytic virus nucleotide sequence has no modifications in the coding regions comprising SEQ ID NOs: 131-452, or wherein any modifications within the coding regions (SEQ ID NOs: 131-452) do not change the amino acid sequence of the encoded proteins; the oncolytic virus nucleotide sequence comprises a nucleotide sequence that is at least 90%, 95%, 96%, 97%, 98%, 99%, 99.5%, 99.9% or 100% identical to: SEQ ID NO: 2 over the entire length of SEQ ID NO: 2, but lacks the JR2 gene sequence and comprises nucleotide sequences that encode the proteins having SEQ ID NOs: 453-653, or a variant of each thereof having 1, 2, 3, 4, or 5 single amino acid substitutions.

In various embodiments: the OV19t comprises a nucleotide sequence that is at least 90%, 95%, 96%, 97%, 98%, 99%, 99.5%, 99.9% or 100% identical to: SEQ ID NO: 1 over the entire length of SEQ ID NO: 1, and encodes proteins having the amino acid sequences of SEQ ID NOs: 453-653, or a variant of each thereof having 1, 2, 3, 4, or 5 amino acid substitutions; the OV19t comprises a nucleotide sequence: a) that is at least 90%, 95%, 96%, 97%, 98%, 99%, 99.5%, 99.9% or 100% identical to: SEQ ID NO: 1 over the entire length of SEQ ID NO: 1, but lacks the 5' ITR sequence and the 3' ITR sequence of SEQ ID NO: 1; and b) encodes proteins having the amino acid sequences of SEQ ID NOs: 453-653, or a variant of each thereof having 1, 2, 3, 4, or 5 amino acid substitutions; the oncolytic virus sequence is at least 90%, 95%, 96%, 97%, 98%, 99%, 99.5%, 99.9% or 100% identical to: SEQ ID NO: 2 over the entire length of SEQ ID NO: 2, but lacks the 5' ITR sequence, the 3' ITR sequence and the J2R gene sequence of SEQ ID NO: 2; OV19t is at least 90%, 95%, 96%, 97%, 98%, 99%, 99.5%, 99.9% or 100% identical to: SEQ ID NO: 2 over the entire length of SEQ ID NO: 2 except that the nucleotide sequence encoding CD19t and a promoter sequence for expressing CD19t replaces at least 10 contiguous nucleotides of the JR2 gene sequence; and at least about 10, 20, 30, 40, 50, 60, 70, 80, 90, 100, 125, 150, 175, 200, 225, 250, 275, 300, 325, 250, 275, 400, 425, 450, 475, or 500 nucleotides (nts) of the J2R gene sequence have been deleted (e.g., the deletion comprises nucleotides 77682-78084 of SEQ ID NO:2).

In various embodiments: the nucleotide sequence encoding CD19t is inserted into a noncoding region of SEQ ID NO:2; the nucleotide sequence encoding CD19t encodes the extracellular domain and the transmembrane domain of CD19; the nucleotide sequence encoding CD19t does not encode the entirety of the cytoplasmic domain of CD19; the CD19t comprises an amino acid sequence that comprises or consists of SEQ ID NOs: 3-4; the nucleotide sequence encoding CD19t is operably linked to a synthetic early promoter; the TCE comprises a domain that binds CD19 and a domain that binds CD3; the domain that binds CD19 is a CD19-targeted scFv and the domain that binds CD3 is a CD3-targeted scFv; the CD19 targeted scFv comprises any one of the following:
a variable light chain region having CDR1, CDR2, and CDR3 regions comprising SEQ ID NOs: 66-68 and a variable light chain region having CDR1, CDR2, and CDR3 regions comprising SEQ ID NOs: 70-72;
a variable light chain region having CDR1, CDR2, and CDR3 regions comprising SEQ ID NOs: 74-76 and a variable light chain region having CDR1, CDR2, and CDR3 regions comprising SEQ ID NOs: 78-80;
a variable light chain region having CDR1, CDR2, and CDR3 regions comprising SEQ ID NOs: 82-84 and a variable light chain region having CDR1, CDR2, and CDR3 regions comprising SEQ ID NOs: 86-88;
a variable light chain region comprising SEQ ID NO: 69 and a variable heavy region comprising SEQ ID NO: 73;
a variable light chain region comprising SEQ ID NO: 77 and a variable heavy region comprising SEQ ID NO: 81; and
a variable light chain region comprising SEQ ID NO: 85 and a variable heavy region comprising SEQ ID NO: 89.

In various embodiments: the CD3 targeted scFv comprises any one of the following:
a variable light chain region having CDR1, CDR2, and CDR3 regions comprising SEQ ID NOs: 90-92 and a variable light chain region having CDR1, CDR2, and CDR3 regions comprising SEQ ID NOs: 94-96;
a variable light chain region having CDR1, CDR2, and CDR3 regions comprising SEQ ID NOs: 98-100 and a variable light chain region having CDR1, CDR2, and CDR3 regions comprising SEQ ID NOs: 102-104;
a variable light chain region having CDR1, CDR2, and CDR3 regions comprising SEQ ID NOs: 106-108 and a variable light chain region having CDR1, CDR2, and CDR3 regions comprising SEQ ID NOs: 110-112;
a variable light chain region comprising SEQ ID NO: C93 and a variable heavy region comprising SEQ ID NO: 97;
a variable light chain region comprising SEQ ID NO: 101 and a variable heavy region comprising SEQ ID NO: 105; and
a variable light chain region comprising SEQ ID NO: 109 and a variable heavy region comprising SEQ ID NO: 113.

In various embodiments: the TCE comprises any one of SEQ ID NOs: 931-934.

In some embodiments, the methods comprise administering to the subject, any of the oncolytic viruses described herein; and, simultaneously or subsequently, administering to the subject a TCE described herein (e.g., TCE-CD19). In some embodiments, the TCE is administered at least or about 1, 2, 3, 4, 5, 6, 7, 8, 9, 10, 11, 12, 13, 14, 15, 26, 17, 18, 19, or 20 days after administration of the oncolytic virus. In some embodiments, the TCE is administered at least or about 1, 2, 3, 4, 5, 6, 7, 8, 9, or 10 weeks after administration of the oncolytic virus. In some embodiments, the TCE is administered at least or about 1, 2, 3, 4, 5, 6, 7, 8, 9, 10, 11, 12, or 13 months after administration of the oncolytic virus.

In some embodiments, the solid tumor includes any one or more of: a sarcoma (e.g., tumors in a blood vessel, bone, fat tissue, ligament, lymph vessel, muscle or tendon), a carcinoma (e.g., tumors that form in epithelial cells), adrenocortical carcinoma, non-small cell lung carcinoma, gall bladder cancer, pancreatic cancer, prostate cancer, and urinary bladder cancer, gastric cancer, bone cancer, breast cancer, cervical cancer, colon cancer, rectal cancer, endometrial cancer, esophageal cancer, skin cancer, lung cancer, ovarian cancer, testicular cancer, thyroid cancer, etc., a metastases of one or more of these cancers, or a subpopulation of one or more of these or other cancers. In some embodiments, the solid tumor includes any cancer cell expressing CD19, HER2, The 5' ITR can comprise about 1000, 1500, 2000, 2500, 3000, 3500, 4000, 4500, 5000, 5500, 6000, 6500, 7000, 7500, 8000, 8500, 9000, 9500, 10000, 10050, or 11,000 nucleotides (nts) on the 5' end of SEQ ID NO:1 or 2, and the 3' ITR can comprise about 1000, 1500, 2000, 2500, 3000, 3500, 4000, 4500, 5000, 5500, 6000, 6500, 7000, 7500, 8000, 8500, 9000, 9500, 10000, 10050, or 110000 nucleotides (nts) on the 3' end of SEQ ID NO:1 or 2. In some embodiments, the 5' ITR comprises or consists of nucleotides (nt) 1-5,013 of SEQ ID NO:1, and the 3' ITR comprises or consists of nucleotides (nt) 178,074-182,474 of SEQ ID NO:1. In some embodiments, the 5' ITR comprises or consists of nucleotides (nt) 1-4,054 of SEQ ID NO:2, and the 3' ITR comprises or consists of nucleotides (nt) 185,351-189,404 of SEQ ID NO:2. In some embodiments, the 5' ITR comprises or consists of nucleotides (nt) 1-5,013 of SEQ ID NO:5, and the 3' ITR comprises or consists of nucleotides (nt) 189,901-190,949 of SEQ ID NO:5.

The chimeric oncolytic poxviruses as described herein include transgene (e.g., encoding human a truncated human CD19 (CD19t) that lacks a functional signaling domain, but includes the extracellular domain and transmembrane domain). In some embodiments, the truncated human CD19 comprises the amino acid sequence (or a sequence at least 95%, 97%, 98% or 99% identical to) MPPPRLLFFLLFLTP-MEVRPEEPLVVKVEEGD-NAVLQCLKGTSDGPTQQLTWSRE SPLKP-FLKLSLGLPGLGIHMRPLAIWLFIFNVSQQMGGFYLC QPGPPSEKAWQPG WTVNVEGSGELFRWNVSDLG-GLGCGLKNRSSEGPSSPSGKLMSPKLYVWAKDR PEI-WEGEPPCVPPRDSLNQSLSQDLTMAPG-STLWLSCGVPPDSVSRGPLSWTHVH PKGPKSLLSLELKDDRPARDMWVMETGLLL-PRATAQDAGKYYCHRGNLTMSFH LEIT-ARPVLWHWLLRTGGWKVSAVTLAY-LIFCLCSLVGILHLQRALVLRRKR (SEQ ID NO: 3). In some cases, the CD19t comprises or consists of amino acids 22-323 of SEQ ID NO: 3 (e.g., SEQ ID NO:4).

Amino acids 1-21 of SEQ ID NO: 3 are a signaling domain and can be replaced with a different signaling domain. Thus, the oncolytic virus comprises a sequence comprising a nucleotide sequence encoding a truncated human CD19 operably linked to an expression control sequence (e.g., an early promoter).

In some embodiments, the truncated human CD19 comprises or consists of the amino acid sequence (or a sequence at least 95%, 97%, 98% or 99% identical to)

```
                                    (SEQ ID NO: 4)
EPLVVKVEEGDNAVLQCLKGTSDGPTQQLTWSRESPLKPFLKLSLGLPG

LGIHMRPLAIWLFIFNVSQQMGGFYLCQPGPPSEKAWQPGWTVNVEGSG

ELFRWNVSDLGGLGCGLKNRSSEGPSSPSGKLMSPKLYVWAKDRPEIWE

GEPPCVPPRDSLNQSLSQDLTMAPGSTLWLSCGVPPDSVSRGPLSWTHV

HPKGPKSLLSLELKDDRPARDMWVMETGLLLPRATAQDAGKYYCHRGNL

TMSFHLEITARPVLWHWLLRTGGWKVSAVTLAYLIFCLCSLVGILHLQR

ALVLRRKR.
```

In some embodiments, the CD19t comprises an amino acid sequence that comprises or consists of SEQ ID NOs: 3-4. In some embodiments, the CD19t operably linked to a promoter, optionally wherein the promoter is a synthetic early promoter.

Sequence identity for nucleotide and amino acid sequences are calculated using BLAST 2.0 with the default parameters. The percent sequence identity refers to a global alignment between the sequences.

In some embodiments, the recombinant oncolytic virus that includes a transgene, e.g., a transgene in an expression cassette wherein the transgene encodes all or a portion of human CD19 (UniProt ID: P15391). The expressed portion of CD19 a portion that can be expressed on the cell surface and can be recognized by an anti-CD19 antibody.

Also described herein are methods of treating a subject having a solid tumor comprising:

administering to the subject an effective amount of an oncolytic virus expressing a human truncated CD19 (CD19t); and administering to the subject an effective amount of a CD19-targeting therapy that binds to CD19t;

wherein the nucleotide sequence of the oncolytic virus expressing CD19t (OV19t) comprises:

(a) an oncolytic virus nucleotide sequence encoding at least 25, 50, 60, 70, 80, 90, 100, 110, 120, or 121 of SEQ ID NOs: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928; and (b) a transgene comprising a nucleotide sequence encoding the CD19t.

Also described herein are methods of treating a subject having a solid tumor comprising:

administering to the subject an effective amount of an oncolytic virus expressing a truncated CD19 (CD19t), wherein the nucleotide sequence of oncolytic virus (OV19t) comprises:

(a) an oncolytic virus nucleotide sequence; and (b) a nucleotide sequence encoding a truncated human CD19 (CD19t); and administering to the subject an effective amount of a therapy that binds to the CD19t;

wherein the oncolytic virus nucleotide sequence comprises a nucleotide sequence that is at 90%, 95%, 96%, 97%, 98%, 99%, 99.5%, 99.9%, or 100% identical to or has no more than 300 single nucleotide changes compared to:

a) SEQ ID NO: 2 over the entire length of SEQ ID NO: 2, but lacks a functional JR2 gene sequence of SEQ ID NO: 2;

b) SEQ ID NO: 2 over the entire length of SEQ ID NO: 2, but lacks a functioning JR2 gene sequence, the 5' ITR sequence and the 3' ITR sequence of SEQ ID NO: 2 (e.g., a nucleotide sequence that is at 90%, 95%, 96%, 97%, 98%, 99%, 99.5%, 99.9%, or 100% identical to nt 4,055-77,602 of SEQ ID NO:2 and a nucleotide sequence that is at 90%, 95%, 96%, 97%, 98%, 99%, 99.5%, 99.9%, or 100% identical to nt 78,137-158,350 of SEQ ID NO:2); or c) nucleotides 4,055-185,350 of SEQ ID NO:2 over the entire length of nucleotides 4,055-185,350 SEQ ID NO: 2, but all or a portion of the J2R sequence;

optionally, further comprising administering to the subject an effective amount of a CD19-targeting therapy that binds to the CD19t.

In various embodiments of any of the methods described herein: the OV19t does not encode functional thymidine kinase; and/or the OV19t does not encode any of: an AFP, a C125, a BCMA, a BCMAt, a CD20, a CD33, a CD22, a CD123, a CD30, a CD38, a GPC-3, a CEA, a HER2, a GD2, a PSMA, a Claudin 18.2, a EpCAM, a GD2, a MSLN, an EGFR, an EGFRVIII, a Trop-2, a c-MET, a Nectin-4, a CD79b, a CCK4, a GPA33, a HLA-2, a CLEC12A, a p-cadherin, a TDO2, a MART-I, a MUCI, a Pmel 17, a MAGE-I, a TRP-1, a TRP-2, a NY-ESQ, a PSA, a CDK4, a BC225, a CA 125, a MG7-Ag, a NY-CO-I, a RCAS 1, a SDCCAG16, a TAAL6, and a TAG72, and optionally functional variants of one or more thereof; the oncolytic virus nucleotide sequence has no modifications in the coding regions comprising SEQ ID NOs: XX1-XX275, or wherein any modifications within the coding regions (SEQ ID NOs: XX1-XX275) do not change the amino acid sequence of the encoded protein; the oncolytic virus nucleotide sequence comprises a nucleotide sequence that is at least 90%, 95%, 96%, 97%, 98%, 99%, 99.5%, 99.9%, 99.99%, or 100% identical to or has no more than 100 single nucleotide changes compared to: SEQ ID NO: 2 over the entire length of SEQ ID NO: 2, but lacks all or a portion of the JR2 gene sequence and comprises nucleotide sequences that encode the proteins having SEQ ID NOs: 654-928, or a variant thereof having 1, 2, 3, 4, or 5 single amino acid substitutions; the OV19t comprises a nucleotide sequence has no more than 100 single nucleotide changes compared to: SEQ ID NO: 1 excepting the 5' ITR and the 3' ITR over the entire length of SEQ ID NO: 1 excepting the 5' ITR and the 3' ITR, and encodes proteins having the amino acid sequences of SEQ ID NOs: SEQ ID NO:654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928, or a variant thereof having 1, 2, 3, 4, or 5 single amino acid substitutions;

the OV19t comprises a nucleotide sequence has no more than 100 single nucleotide changes compared to: SEQ ID NO: 5 excepting the 5' ITR and the 3' ITR over the entire length of SEQ ID NO: 5 excepting the 5' ITR and the 3' ITR, and encodes proteins having the amino acid sequences of SEQ ID NOs: SEQ ID NO: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928, or a variant thereof having 1, 2, 3, 4, or 5 single amino acid substitutions;

the OV19t comprises a nucleotide sequence:
a) that is at least 90%, 95%, 96%, 97%, 98%, 99%, 99.5%, 99.9% or 100% identical to or has no more than 100 single nucleotide changes compared to: SEQ ID NO: 1 over the entire length of SEQ ID NO: 1, but lacks the 5' ITR sequence and the 3' ITR sequence of SEQ ID NO: 1; and
b) encodes proteins having the amino acid sequences of SEQ ID NOs: 654-928, or a variant of thereof having 1, 2, 3, 4, or 5 single amino acid substitutions;

optionally, wherein the 5' ITR comprises or consists of nucleotides (nt) 1-5,013 of SEQ ID NO:1, and the 3' ITR comprises or consists of nucleotides (nt) 178, 074 182,474 of SEQ ID NO:1;
the OV19t comprises a nucleotide sequence:
a) that is at least 90%, 95%, 96%, 97%, 98%, 99%, 99.5%, 99.9% or 100% identical to or has no more than 100 single nucleotide changes compared to: SEQ ID NO: 5 over the entire length of SEQ ID NO: 5, but lacks the 5' ITR sequence and the 3' ITR sequence of SEQ ID NO: 5; and
b) encodes proteins having the amino acid sequences of SEQ ID NOs: 654-928, or a variant of thereof having 1, 2, 3, 4, or 5 single amino acid substitutions;
optionally, wherein the 5' ITR comprises or consists of nucleotides (nt) 1-5,013 of SEQ ID NO:5, and the 3' ITR comprises or consists of nucleotides (nt) 189, 901-190,949 of SEQ ID NO:5.
the oncolytic virus sequence is at least 90%, 95%, 96%, 97%, 98%, 99%, 99.5%, 99.9% or 100% identical to or has no more than 300 single nucleotide changes compared to nt 4,055-77,602 of SEQ ID NO:2 and nt 78,137-158,350 SEQ ID NO: 2 over the entire length of nt 4,055-77,602 of SEQ ID NO:2 and nt 78,137-158, 350 SEQ ID NO: 2;
the OV19t is at least 90%, 95%, 96%, 97%, 98%, 99%, 99.5%, 99.9% or 100% identical to or has no more than 300 single nucleotide changes compared to: SEQ ID NO: 2 over the entire length of SEQ ID NO: 2 except that the nucleotide sequence encoding CD19t and a promoter sequence for expressing CD19t replaces at least 10 contiguous nucleotides of the JR2 gene sequence;
at least about 10, 20, 30, 40, 50, 60, 70, 80, 90, 100, 125, 150, 175, 200, 225, 250, 275, 300, 325, 250, 275, 400, 425, 450, 475, or 500 contiguous nucleotides of the J2R gene sequence (nt 77,603-78,136 of SEQ ID NO:2) have been deleted;
the deletion comprises nucleotides 77,682-78,084 of SEQ ID NO:2;
the nucleotide sequence encoding CD19t is inserted into a noncoding region of SEQ ID NO:2;
the nucleotide sequence encoding CD19t encodes the extracellular domain and the transmembrane domain of CD19;
the nucleotide sequence encoding CD19t does not encode the entirety of the cytoplasmic domain of CD19;
the CD19t comprises an amino acid sequence that comprises or consists of SEQ ID NO: 3 or 4;
the nucleotide sequence encoding CD19t is operably linked to a promoter;
the therapy that binds to the CD19t is a TCE comprising a domain that binds CD19 and a domain that binds CD3;
the domain that binds CD19 is a CD19-targeted scFv and the domain that binds CD3 is a CD3-targeted scFv;
the CD19-targeting therapy comprises:
(a) a CD19 target domain comprising:
a variable heavy (VH) chain as set forth in Table 5, or a variant thereof having 1, 2, 3, 4, or 5 single amino acid modifications (e.g., conservative substitutions), wherein the modifications are not in a CDR region, and
a variable light (VL) chain as set forth in Table 5, or a variant thereof having 1, 2, 3, 4, or 5 single amino acid modifications (e.g., conservative substitutions), wherein the modifications are not in a CDR region; and (b) a CD3 target domain comprising:

a variable heavy (VH) chain as set forth in Table 6, or a variant thereof having 1, 2, 3, 4, or 5 single amino acid modifications (e.g., conservative substitutions), wherein the modifications are not in a CDR region, and a variable light (VL) chain as set forth in Table 6, or a variant thereof having 1, 2, 3, 4, or 5 single amino acid modifications (e.g., conservative substitutions), wherein the modifications are not in a CDR region;

the TCE comprises any one of the constructs set forth in Table 4;

the CD19-targeting therapy comprises a population of autologous or allogeneic human immune cells expressing a chimeric antigen receptor (CAR) or harboring a nucleic acid encoding a CAR, wherein the CAR comprises a CD19-targeting domain comprising a CD19-targeted scFv (e.g., as set forth in Tables 4-6), a spacer (e.g., as set forth in Table 2), a transmembrane domain (e.g., as set forth in Table 1), a costimulatory domain (e.g., as set forth in Table 3), and a CD3z signaling domain (e.g., as set forth in Table 3).

In some embodiments of any of the methods described herein, the solid tumor comprises HER2-positive cells. In some embodiments of any of the methods described herein, the method further comprises administering an effective amount of a population immune cells expressing a HER2 CAR (e.g., a CAR comprising SEQ ID NO: 57, or a variant thereof having 1, 2, 3, 4, or 5 amino acid substitutions) or harboring a nucleic acid encoding a CAR (e.g., HER2 CAR T cells).

Also described herein are oncolytic viruses expressing a truncated CD19 (OV19t), the nucleotide sequence of OV19t comprising:

(a) an oncolytic virus nucleotide sequence; and (b) a nucleotide sequence encoding a truncated human CD19 (CD19t);

wherein the oncolytic virus nucleotide sequence encodes at least 25, 50, 60, 70, 80, 90, 100, 110, 120, or 121 of SEQ ID NO: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928; and/or wherein the OV19t nucleotide sequence is at least 90%, 95%, 96%, 97%, 98%, 99%, 99.5%, 99.9% identical to or has no more than 300 single nucleotide changes compared to:

i) nucleotides 5,014-178,073 of SEQ ID NO:1 over the entire length of nucleotides 5,014-178,073 SEQ ID NO: 1;

ii) nucleotides 7,000-178,000 of SEQ ID NO:1 over the entire length of nucleotides 7,000-178,000 SEQ ID NO: 1;

iii) nucleotides 8,000-177,000 of SEQ ID NO:1 over the entire length of nucleotides 8,000-177,000 SEQ ID NO: 1;

iv) nucleotides 10,000-175,000 of SEQ ID NO:1 over the entire length of nucleotides 10,000-175, 000 SEQ ID NO: 1;

v) nucleotides 5,014-186,900 of SEQ ID NO:5 over the entire length of nucleotides 5,014-186,900 SEQ ID NO: 5;

vi) nucleotides 7,000-186,000 of SEQ ID NO:5 over the entire length of nucleotides 7,000-186,000 SEQ ID NO: 5;

vii) nucleotides 8,000-185,000 of SEQ ID NO:1 over the entire length of nucleotides 8,000-185,000 SEQ ID NO: 5; or viii) nucleotides 10,000-184,000 of SEQ ID NO:1 over the entire length of nucleotides 10,000-184, 000 SEQ ID NO: 5.

In some embodiments, the OV19t nucleotide sequence is at least 95%, 96%, 97%, 98%, 99%, 99.5%, 99.6%, 99.7%, 99.8%, 99.9%, 99.99%, or 100% identical to or has no more than 100 single nucleotide changes compared to:

i) SEQ ID NO: 1 over the entire length of SEQ ID NO: 1;

ii) SEQ ID NO: 1 over the entire length of SEQ ID NO: 1, but lacks the 5' ITR sequence and the 3' ITR sequence of SEQ ID NO: 1;

iii) nucleotides 5,014-178,073 of SEQ ID NO:1 over the entire length of nucleotides 5,014-178,073 SEQ ID NO: 1;

iv) nucleotides 7,000-178,000 of SEQ ID NO:1 over the entire length of nucleotides 7,000-178,000 SEQ ID NO: 1;

v) nucleotides 8,000-177,000 of SEQ ID NO:1 over the entire length of nucleotides 8,000-177,000 SEQ ID NO: 1; or vi) nucleotides 10,000-175,000 of SEQ ID NO:1 over the entire length of nucleotides 10,000-175,000 SEQ ID NO: 1.

In some embodiments, any nucleotide modifications in the oncolytic virus nucleotide sequence do not change the amino acid sequence of encoded proteins having an amino acid sequences SEQ ID NO: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928.

In some embodiments, any nucleotide modifications in the oncolytic virus nucleotide sequence do not change the amino acid sequence of encoded proteins having an amino acid sequences SEQ ID NO: 654-928.

In some embodiments, the OV19t does not encode any of an AFP, a C125, a CD19, a CD19t, a CD20, a CD33, a CD22, a CD123, a CD30, a CD38, a GPC-3, a CEA, a HER2, a GD2, a PSMA, a Claudin 18.2, a EpCAM, a GD2, a MSLN, an EGFR, an EGFRVIII, a Trop-2, a c-MET, a Nectin-4, a CD79b, a CCK4, a GPA33, a HLA-2, a CLEC12A, a p-cadherin, a TDO2, a MART-I, a MUCI, a Pmel 17, a MAGE-I, a TRP-1, a TRP-2, a NY-ESQ, a PSA, a CDK4, a BC225, a CA 125, a MG7-Ag, a NY-CO-I, a RCAS 1, a SDCCAG16, a TAAL6, and a TAG72, and optionally functional variants of one or more thereof.

In some embodiments, the nucleotide sequence encoding CD19t encodes the extracellular domain and the transmembrane domain of CD19.

In some embodiments, the nucleotide sequence encoding CD19t does not encode the entirety of the cytoplasmic domain of CD19.

In some embodiments, the CD19t comprises an amino acid sequence that comprises or consists of SEQ ID NO: 3 or 4.

In some embodiments, the nucleotide sequence encoding CD19t is operably linked to a promoter.

Described herein, inter alia, are oncolytic viruses expressing a truncated CD19 (OV19t) comprising a nucleotide sequence that is at least 90%, 95%, 96%, 97%, 98%, 99%, 99.5%, 99.6%, 99.7%, 99.8%, 99.9%, 99.99%, or 100% identical to or has no more than 100 single nucleotide changes compared to nucleotides 6,000-176,000 of SEQ ID NO: 1 over the entire length of nucleotides 6,000-176,000 of SEQ ID NO: 1. Described herein, inter alia, are oncolytic viruses comprising a nucleotide sequence that has no more than 300, 200, or 100 single nucleotide changes compared to nucleotides 6,000-176,000 of SEQ ID NO: 1.

Described herein, inter alia, are oncolytic viruses expressing a truncated CD19 (OV19t) comprising a nucleotide sequence that is at least 90%, 95%, 96%, 97%, 98%, 99%, 99.5%, 99.6%, 99.7%, 99.8%, 99.9%, 99.99%, or 100% identical to or has no more than 100 single nucleotide changes compared to nucleotides 5,014-186,900 of SEQ ID NO: 5 over the entire length of nucleotides 5,014-186,900 of SEQ ID NO: 5. Described herein, inter alia, are oncolytic viruses comprising a nucleotide sequence that has no more than 300, 200, or 100 single nucleotide changes compared to nucleotides 5,014-186,900 of SEQ ID NO: 5.

Described herein, inter alia, are oncolytic viruses expressing a truncated CD19 (OV19t) comprising a nucleotide sequence that is at least 90%, 95%, 96%, 97%, 98%, 99%, 99.5%, 99.6%, 99.7%, 99.8%, 99.9%, 99.99%, or 100% identical to or has no more than 500, 450, 400, 350, 300, 250, 200, 150, 100, 50, 25, 10, 5, or 1 single nucleotide changes compared to nucleotides 5,000-175,000 of SEQ ID NO: 1 over the entire length of nucleotides 5,000-175,000 of SEQ ID NO: 1. Described herein, inter alia, are oncolytic viruses expressing a truncated CD19 (OV19t) comprising a nucleotide sequence that has no more than 500, 450, 400, 350, 300, 250, 200, 150, 100, 50, 25, 10, 5, or 1 single nucleotide changes compared to nucleotides 5,000-175,000 of SEQ ID NO: 1. Described herein, inter alia, are oncolytic viruses expressing a truncated CD19 (OV19t) comprising a nucleotide sequence that has no more than 500, 450, 400, 350, 300, 250, 200, 150, 100, 50, 25, 10, 5, or 1 single nucleotide changes compared to nucleotides 5,000-175,000 of SEQ ID NO: 5.

Also described herein are oncolytic viruses expressing a truncated CD19 (OV19t), the nucleotide sequence of OV19t comprising:

(a) an oncolytic virus nucleotide sequence; and (b) a nucleotide sequence encoding a truncated human CD19 (CD19t);

wherein the oncolytic virus nucleotide sequence encodes at least 25, 50, 60, 70, 80, 90, 100, 110, 120, or 121 of SEQ ID NO: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928; and/or wherein the OV19t nucleotide sequence comprises nucleotides 6,000-176,000 of SEQ ID NO:1 or a variant thereof with up to 100, 200, or 300 nucleotide substitutions.

In some embodiments, the OV19t nucleotide sequence comprises nucleotides 5,014-178,073 of SEQ ID NO:1 or a variant thereof with up to 100 nucleotide substitutions (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

In some embodiments, the OV19t nucleotide sequence comprises nucleotides 6,000-176,000 of SEQ ID NO:1 or a variant thereof with up to 100 nucleotide substitutions (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

In some embodiments, the oncolytic virus comprises at least 25, 50, 75, 100, 125, 150, 175, 200, 225, or 250 of SEQ ID NO: XX1-XX275.

In some embodiments, the OV19t does not encode any of an AFP, a C125, a CD19, a CD19t, a CD20, a CD33, a CD22, a CD123, a CD30, a CD38, a GPC-3, a CEA, a HER2, a GD2, a PSMA, a Claudin 18.2, a EpCAM, a GD2, a MSLN, an EGFR, an EGFRVIII, a Trop-2, a c-MET, a Nectin-4, a CD79b, a CCK4, a GPA33, a HLA-2, a CLEC12A, a p-cadherin, a TDO2, a MART-I, a MUCI, a Pmel 17, a MAGE-I, a TRP-1, a TRP-2, a NY-ESQ, a PSA, a CDK4, a BC225, a CA 125, a MG7-Ag, a NY-CO-I, a RCAS 1, a SDCCAG16, a TAAL6, and a TAG72, and optionally functional variants of one or more thereof.

In some embodiments, the nucleotide sequence encoding CD19t encodes the extracellular domain and the transmembrane domain of CD19. In some embodiments, the nucleotide sequence encoding CD19t does not encode the entirety of the cytoplasmic domain of CD19. In some embodiments, the CD19t comprises an amino acid sequence that comprises or consists of SEQ ID NO: 3 or 4.

In some embodiments, the nucleotide sequence encoding CD19t is operably linked to a promoter.

Also described herein are oncolytic viruses expressing a truncated CD19 (OV19t) comprising nucleotides 5,014-178, 073 of SEQ ID NO: 1 or a variant thereof with up to 100 nucleotide modifications (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

Also described herein are oncolytic viruses expressing a truncated CD19 (OV19t) comprising nucleotides 5,014-186, 900 of SEQ ID NO: 5 or a variant thereof with up to 100 nucleotide modifications (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

Also described herein are oncolytic viruses expressing a truncated CD19 (OV19t) comprising nucleotides 6,000-177, 000 of SEQ ID NO: 1 or a variant thereof with up to 100 nucleotide modifications (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

Also described herein are oncolytic viruses expressing a truncated CD19 (OV19t) comprising nucleotides 6,000-184, 000 of SEQ ID NO: 5 or a variant thereof with up to 100 nucleotide modifications (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotide substitutions).

An oncolytic virus described herein (e.g., OV19t) can be administered in single or repeated doses. An OV19t can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, preservatives and antioxidants can also be present in the compositions.

Pharmaceutical formulations can be prepared according to any method known to the art for the manufacture of pharmaceuticals. Formulations of the compositions of the invention include those suitable for intradermal, subcutaneous, intravenous, transdermal, intraperitoneal, intramuscular, pulmonary, and/or parenteral administration. The formulations may conveniently be presented in unit dosage form and may be prepared by any methods well known in the art of pharmacy. The amount of active ingredient (e.g., an OV19t) which can be combined with a carrier to produce a single dosage form will vary depending upon the host being treated, the particular mode of administration, e.g., subcutaneous or intravenous. The amount of active ingredient which can be combined with a carrier to produce a single dosage form will generally be that amount of the compound which produces a therapeutic effect, e.g., expression of a CD19 or CD19t molecule on the surface of an infected cell, e.g., an infected solid tumor cell. Useful carriers are well known in the art and can include phosphate buffered saline solutions, water, liposomes, various types of wetting agents, sterile solutions, etc. Preparations for parenteral administration include sterile aqueous or non-aqueous solutions, or suspensions. Examples of non-aqueous solvents are propylene glycol, polyethylene glycol, and injectable organic esters such as ethyl oleate. Aqueous carriers include water, aqueous solutions, or suspensions, including saline and buffered media. Parenteral vehicles include sodium chloride solution, Ringer's dextrose, dextrose and sodium chloride, or lactated Ringer's. Intravenous vehicles include fluid and nutrient replenishes, electrolyte replenishers (such as those based on Ringer's dextrose), and the like. Preservatives and other additives may also be present such as, for example, antimicrobials, anti-oxidants, chelating agents, and inert gases and the like. In addition, the composition might comprise proteinaceous carriers, like, e.g., serum albumine or immunoglobuline, preferably of human origin.

Generally, an "effective amount" means a dose that produces the effects for which it is administered, e.g., an amount of an OV19t described herein sufficient to infect at least one solid tumor cell or cancer cell or sufficient to express CD19t on the surface of at least one solid tumor cell or cancer cell. The exact dose will depend on the purpose of the treatment, and will be ascertainable by one skilled in the art using known techniques. The attending physician and clinical factors will determine the dosage regimen. As is well known in the medical arts, dosages for any one pediatric patient depends upon many factors, including the pediatric patient's size, body surface area, age, body weight, the particular compound to be administered, sex, time and route of administration, general health status, and other drugs being administered concurrently.

Bispecific T cell Engagers (TCEs)

In some embodiments, the methods described herein comprise the use of TCEs (e.g., agents that binds to CD3 and to CD19 or CD19t).

TCEs have emerged as a technology that is capable of re-directing cytotoxic T-cells, independent of their natural T-cell receptor (TCR) specificity, to tumor antigens [24]. However, a fundamental challenge for designing effective TCE therapies for solid tumors is the identification of tumor selective targeting antigens [24]. The combination of treating a subject with an OV19t and a CD19-TCE, as described herein, overcomes this challenge and leads to the efficient killing of tumor cells.

There are a number of CD19-TCEs known in the art that can be used in any of the methods described herein. For example, a useful CD19 TCE can include BLINCYTO® (blinatumomab). Blinatumomab, a BiTE composed of two scFv domains (one targeting CD19 on malignant B-cells and the other targeting CD3 on T-cells) connected by a linker, to induce a cytolytic synapse between a T-cell and a CD19-positive tumor cell, is FDA approved for treatment of cancers, such as relapsed and refractory acute lymphoblastic leukemia [24].

A TCE described herein can be administered in single or repeated doses.

A TCE can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, preservatives and antioxidants can also be present in the compositions.

Pharmaceutical formulations can be prepared according to any method known to the art for the manufacture of pharmaceuticals. Formulations of the compositions of the invention include those suitable for intradermal, subcutaneous, intravenous, transdermal, intraperitoneal, intramuscular, pulmonary, and/or parenteral administration. The formulations may conveniently be presented in unit dosage form and may be prepared by any methods well known in the art of pharmacy. The amount of active ingredient (e.g., a CD19 TCE) which can be combined with a carrier to produce a single dosage form will vary depending upon the host being treated, the particular mode of administration, e.g., subcutaneous or intravenous. The amount of active ingredient which can be combined with a carrier to produce a single dosage form will generally be that amount of the compound which produces a therapeutic effect, e.g., an antigen specific T cell response. Useful carriers are well known in the art and can include phosphate buffered saline solutions, water, liposomes, various types of wetting agents, sterile solutions, etc. Preparations for parenteral administration include sterile aqueous or non-aqueous solutions, or suspensions. Examples of non-aqueous solvents are propylene glycol, polyethylene glycol, and injectable organic esters such as ethyl oleate. Aqueous carriers include water, aqueous solutions, or suspensions, including saline and buffered media. Parenteral vehicles include sodium chloride solution, Ringer's dextrose, dextrose and sodium chloride, or lactated Ringer's. Intravenous vehicles include fluid and nutrient replenishes, electrolyte replenishers (such as those based on Ringer's dextrose), and the like. Preservatives and other additives may also be present such as, for example, antimicrobials, anti-oxidants, chelating agents, and inert gases and the like. In addition, the composition might comprise proteinaceous carriers, like, e.g., serum albumine or immunoglobuline, preferably of human origin.

Generally, an "effective amount" means a dose that produces the effects for which it is administered, e.g., an amount of a CD19-TCE described herein sufficient to kill at least one cell expressing CD19 (e.g., a solid tumor cell successful infected by OV19t and expressing CD19t) or sufficient to illicit an immune response (e.g., an antigen specific T cell response). The exact dose will depend on the purpose of the treatment, and will be ascertainable by one skilled in the art using known techniques. The attending physician and clinical factors will determine the dosage regimen. As is well known in the medical arts, dosages for any one pediatric patient depends upon many factors, including the pediatric patient's size, body surface area, age, body weight, the particular compound to be administered, sex, time and route of administration, general health status, and other drugs being administered concurrently.

More information on formulations, dosage, and administration of TCEs is known in the art, for example, in US 2023/0235053 A1, WO 2018/204907, WO 2023/199235, and WO 2023/062188.

Examples of additional CD19 TCE constructs, can include any one the following

| Name | Organization/Company | Clinical Stage |
| --- | --- | --- |
| AMG-562 | Amgen | Phase I (NCT03571828) |
| A-319 | Generon (Shanghai) | Phase I (NCT04056975) |
| AFM-11 | Affirmed | Suspended |
| CD3 × CD19 | Avacta | Preclinical |
| GNR-047 | IBC Generium | Preclinical |
| Next-generation CD19 × CD3 DART | MacroGenics | Preclinical |
| ZW-38 | Merck; Zymeworks | Preclinical |
| B-193 | Shandong Danhong; Shanghai Yanyi | Preclinical |
| 19-3-19 | SpectraMab | Preclinical |
| SV-202 | SYSVAX | Preclinical |

16

-continued

| Name | Organization/Company | Clinical Stage |
| --- | --- | --- |
| TNB-486 | TeneoBio | Phase I (NCT04594642) |
| CD3 × CD19 | Tianjin Chase Sun Jinboda | Preclinical |
| CD3 × CD19 | Wuhan YZY | Preclinical |

Adapted from Table 4 of Nie, S., et al. (2020) "Biology drives the discovery of bispecific antibodies as innovative therapeutics" *Antibody Therapeutics,* 3(1):18-62.

A TCE as described herein includes bispecific antibody constructs, which are recombinant protein constructs made from two flexibly linked antibody derived binding domains. One binding domain of a CD19-TCE is specific for CD19, CD19t, or a variant thereof, the second binding domain is specific for CD3 or a variant thereof (e.g., a functional variant). The TCEs and bispecific antibody constructs disclosed herein can be prepared by methods known in the art, for example, by methods disclosed in WO 2008/119657 and WO 2017/134140. TCE constructs are uniquely suited to transiently connect T cells with target cells and, at the same time, potently activate the inherent cytolytic potential of T cells against target cells. First generation TCE constructs (see WO 99/54440 and WO 2005/040220) developed into the clinic as AMG 103 and AMG 110 were then modified by the provision of bispecific antibody constructs binding to a context independent epitope at the N-terminus of the CD3s chain (WO 2008/119567). TCE constructs binding to this CD3 epitope displayed cross-species specificity for human and *Callithrix jacchus, Saguinus oedipus* or *Saimiri sciureus* CD3e chain. Furthermore, binding this specific epitope instead of previously described epitopes for CD3 binders, reduces or eliminates non-specific activation of T cells compared to what was observed for the previous generation of T cell engaging antibodies. This reduction in T cell activation was connected with less or reduced T cell redistribution in patients, which was identified as a risk for side effects. Thus, in some embodiments, the portion of the TCE that targets CD3 can bind to CD3e (e.g., via a scFv targets to CD3e).

An increased half-life is generally useful in in vivo applications of TCEs and immunoglobulins in general, especially antibodies and antibody fragments of small size. Some approaches described in the art to achieve such effect comprise the fusion of the TCE or bispecific antibody construct to larger proteins, which preferably do not interfere with the therapeutic effect of the TCE or bispecific antibody construct. Examples for such further developments of bispecific T cell engagers comprise bispecific Fc-molecules e.g. described in US 2014/0302037, US 2014/0308285, WO 2014/144722, WO 2014/151910, WO 2015/048272, WO 2018/204907, and WO 2020/072306. Antibody constructs as described in WO 2008/119567 are likely to suffer from rapid clearance from the body; thus, whilst they are able to reach most parts of the body rapidly, and are quick to produce and easier to handle, their in vivo applications may be limited by their brief persistence in vivo. Prolonged administration by continuous intravenous infusion is used to achieve therapeutic effects because of the short in vivo half-life of this small, single chain molecule.

In some embodiments, a useful TCE can be a bispecific antibody construct that further comprises a half-life extending (HLE) moiety (e.g., a scFc domain, a heteroFc domain, or an albumin binding domain). In some embodiments, the N-terminus or the C-terminus of the HLE domain is connected to the TCE (e.g., the portion that binds CD3, e.g., the VH or VL of a CD3-targeted scFv). In some embodiments, the HLE domain is connected to the bispecific antibody construct via a linker.

In some embodiments, the TCE is a BiTE, wherein the BiTE further comprises a third domain comprising two polypeptide monomers, each comprises a hinge, a CH2 and a CH3 domain, wherein the two polypeptide monomers are linked to each other via a peptide linker. In another embodiment, the third domain comprises in an amino to carboxyl order hinge-CH2-CH3-linker-hinge-CH2-CH3. In one embodiment, the third domain is a half-life extended (HLE) domain.

A useful TCE can comprise an amino acid sequence having 90, 95, 96, 97, 98, 99, or 10000 identity to any one of SEQ ID NOs: 931-934. A TCE can comprise or consist of an amino acid sequence of any one of SEQ ID NOs: 931-934 or a variant thereof having 1, 2, 3, 4, 5, 6, 7, 8, 9, 10, 15, 20, 25, or 30 amino acid modifications (e.g., substitutions), wherein the modifications are not in the CDR regions; preferably wherein the modifications are conservative.

TABLE 4

| Examples of CD19-TCE Sequences | |
|---|---|
| CD19xCD3 scFv BLINCYTO (with linker) | DIQLTQSPASLAVSLGQRATISCKASQSVDYDGDSYLNWY QQIPGQPPKLLIYDASNLVSGIPPRFSGSGSGTDFTLNIHPV EKVDAATYHCQQSTEDPWTFGGGTKLEIKGGGGSGGGG SGGGGSQVQLQQSGAELVRPGSSVKISCKASGYAFSSYW MNWVKQRPGQGLEWIGQIWPGDGDTNYNGKFKGKATLT ADESSSTAYMQLSSLASEDSAVYFCARRETTTVGRYYYA MDYWGQGTTVTVSSGGGGSDIKLQQSGAELARPGASVK MSCKTSGYTFTRYTMHWVKQRPGQGLEWIGYINPSRGY TNYNQKFKDKATLTTDKSSSTAYMQLSSLTSEDSAVYYCA RYYDDHYCLDYWGQGTTLTVSSVEGGSGGSGGSGGSGG VDDIQLTQSPAIMSASPGEKVTMTCRASSSVSYMNWYQQ KSGTSPKRWIYDTSKVASGVPYRFSGSGSGTSYSLTISSME AEDAATYYCQQWSSNPLTFGAGTKLELK (SEQ ID NO: 931) |
| CD19xCD3 scFv BLINCYTO (with linker and his-tag) | DIQLTQSPASLAVSLGQRATISCKASQSVDYDGDSYLNWY QQIPGQPPKLLIYDASNLVSGIPPRFSGSGSGTDFTLNIHPV EKVDAATYHCQQSTEDPWTFGGGTKLEIKGGGGSGGGG SGGGGSQVQLQQSGAELVRPGSSVKISCKASGYAFSSYW MNWVKQRPGQGLEWIGQIWPGDGDTNYNGKFKGKATLT ADESSSTAYMQLSSLASEDSAVYFCARRETTTVGRYYYA MDYWGQGTTVTVSSGGGGSDIKLQQSGAELARPGASVK MSCKTSGYTFTRYTMHWVKQRPGQGLEWIGYINPSRGY TNYNQKFKDKATLTTDKSSSTAYMQLSSLTSEDSAVYYCA RYYDDHYCLDYWGQGTTLTVSSVEGGSGGSGGSGGSGG VDDIQLTQSPAIMSASPGEKVTMTCRASSSVSYMNWYQQ KSGTSPKRWIYDTSKVASGVPYRFSGSGSGTSYSLTISSME AEDAATYYCQQWSSNPLTFGAGTKLELKHHHHHH (SEQ ID NO: 932) |
| CD19 TCE + I2C0 | MDMRVPAQLLGLLLLWLRGARCDIVMTQSPLSLPVISGEP ASISCRSSQSLLHKNAFNYLDWYLQKPGQSPQLLIYLGSN RASGVPDRFSGSGSGTDFTLKISRVEAEDVGVYYCMQAL QTPFTFGCGTKVDIKGGGGSGGGGSGGGGSQVQLVESGG GVVQPGRSLRLSCAASGFTFSSYGMHWVRQAPGKCLEW VAVISYEGSNKYYAESVKGRFTISRDNSKNTLYLQMNSLR DEDTAVYYCARDRGTIFGNYGLEVWGQGTTVTVSSGGG GSEVQLVESGGGLVQPGGSLKLSCAASGFTFNKYAMNWV RQAPGKGLEWVARIRSKYNNYATYYADSVKDRFTISRDD SKNTAYLQMNNLKTEDTAVYYCVRHGNFGNSYISYWAY WGQGTLVTVSSGGGGSGGGGSGGGGSQTVVTQEPSLTVS PGGTVTLTCGSSTGAVTSGNYPNWVQQKPGQAPRGLIGG TKFLAPGTPARFSGSLLGGKAALTLSGVQPEDEAEYYCVL WYSNRWVFGGGTKLTVL (SEQ ID NO: 933) |
| CD19 TCE + I2C0 scFc | MDMRVPAQLLGLLLLWLRGARCDIVMTQSPLSLPVISGEP ASISCRSSQSLLHKNAFNYLDWYLQKPGQSPQLLIYLGSN RASGVPDRFSGSGSGTDFTLKISRVEAEDVGVYYCMQAL QTPFTFGCGTKVDIKGGGGSGGGGSGGGGSQVQLVESGG GVVQPGRSLRLSCAASGFTFSSYGMHWVRQAPGKCLEW VAVISYEGSNKYYAESVKGRFTISRDNSKNTLYLQMNSLR DEDTAVYYCARDRGTIFGNYGLEVWGQGTTVTVSSGGG GSEVQLVESGGGLVQPGGSLKLSCAASGFTFNKYAMNWV RQAPGKGLEWVARIRSKYNNYATYYADSVKDRFTISRDD SKNTAYLQMNNLKTEDTAVYYCVRHGNFGNSYISYWAY WGQGTLVTVSSGGGGSGGGGSGGGGSQTVVTQEPSLTVS PGGTVTLTCGSSTGAVTSGNYPNWVQQKPGQAPRGLIGG TKFLAPGTPARFSGSLLGGKAALTLSGVQPEDEAEYYCVL WYSNRWVFGGGTKLTVLGGGGDKTHTCPPCPAPELLGGP SVFLFPPKPKDTLMISRTPEVTCVVVDVSHEDPEVKFNWY VDGVEVHNAKTKPCEEQYGSTYRCVSVLTVLHQDWLNG KEYKCKVSNKALPAPIEKTISKAKGQPREPQVYTLPPSREE MTKNQVSLTCLVKGFYPSDIAVEWESNGQPENNYKTTPP VLDSDGSFFLYSKLTVDKSRWQQGNVFSCSVMHEALHNH |

TABLE 4-continued

Examples of CD19-TCE Sequences

```
YTQKSLSLSPGKGGGGSGGGGSGGGGSGGGGSGGGGSG
GGGSDKTHTCPPCPAPELLGGPSVFLFPPKPKDTLMISRTP
EVTCVVVDVSHEDPEVKFNWYVDGVEVHNAKTKPCEEQ
YGSTYRCVSVLTVLHQDWLNGKEYKCKVSNKALPAPIEK
TISKAKGQPREPQVYTLPPSREEMTKNQVSLTCLVKGFYP
SDIAVEWESNGQPENNYKTTPPVLDSDGSFFLYSKLTVDK
SRWQQGNVFSCSVMHEALHNHYTQKSLSLSPGK (SEQ ID
NO: 934)
```

BLINCYTO linker GSGGGGSQVQLQQSGAELVRPGSSVKISCKASGYAFSSY (SEQ ID NO: 935)

A useful TCE comprises a domain that binds CD19 and a domain that binds CD3. In some embodiments, the domain that binds CD19 is a CD319-targeted scFv and the domain that binds CD3 is a CD33-targeted scFv.

In some embodiments, a CD319-targeted scFv comprises:
(a) a heavy chain variable region (VH) comprising a VH complementarity determining region (CDR)1 comprising a sequence that is at least 9500 identical to a VH CDR1 amino acid sequence set forth in Table 5; a VH CDR2 comprising a sequence that is at least 95% identical to a VH CDR2 amino acid sequence set forth in Table 5, and a VH CDR3 comprising a sequence that is at least 95% identical to a VH CDR3 amino acid sequence set forth in Table 5; and
(b) a light chain variable region (VL) comprising a VL CDR1 comprising a sequence that is at least 95% identical to a VL CDR1 amino acid sequence set forth in Table 5, a VL CDR2 comprising a sequence that is at least 95% identical to a VL CDR2 amino acid sequence set forth in Table 5 , and a VL CDR3 comprising a sequence that is at least 95% identical to a VL CDR3 amino acid sequence set forth in Table 5.

In some embodiments, a CD19-targeted scFv comprises a VH comprising or consisting of an amino acid sequence having at least 95% sequence identity to a VH amino acid sequence set forth in Table 5, and a VL comprising or consisting of an amino acid sequence having at least 95% sequence identity to a VL amino acid sequence set forth in Table 5.

A useful CD19-targeted scFv comprises any one of the following:
a variable light chain region having CDR1, CDR2, and CDR3 regions comprising SEQ ID NOs: 66-68 and a variable light chain region having CDR1, CDR2, and CDR3 regions comprising SEQ ID NOs: 70-72;
a variable light chain region having CDR1, CDR2, and CDR3 regions comprising SEQ ID NOs: 74-76 and a variable light chain region having CDR1, CDR2, and CDR3 regions comprising SEQ ID NOs: 78-80;
a variable light chain region having CDR1, CDR2, and CDR3 regions comprising SEQ ID NOs: 82-84 and a variable light chain region having CDR1, CDR2, and CDR3 regions comprising SEQ ID NOs: 86-88;
a variable light chain region comprising SEQ ID NO: 69 and a variable heavy region comprising SEQ ID NO: 73;
a variable light chain region comprising SEQ ID NO: 77 and a variable heavy region comprising SEQ ID NO: 81; and
a variable light chain region comprising SEQ ID NO: 85 and a variable heavy region comprising SEQ ID NO: 89.

TABLE 5

| | CD19-Binding TCE Sequences |
|---|---|
| CD19 VL1 CDR1 | KASQSVDYDGDSYLN (SEQ ID NO: 66) |
| CD19 VL1 CDR2 | DASNLVS (SEQ ID NO: 67) |
| CD19 VL1 CDR3 | QQSTEDPWT (SEQ ID NO: 68) |
| CD19 VL1 | DIQLTQSPASLAVSLGQRATISCKASQSVDYDGDSYLNWY QQIPGQPPKLLIYDASNLVSGIPPRFSGSGSGTDFTLNIHPV EKVDAATYHCQQSTEDPWTFGGGTKLEIK (SEQ ID NO: 69) |
| CD19 VH1 CDR1 | SYWMN (SEQ ID NO: 70) |
| CD19 VH1 CDR2 | QJWPGDGDTNYNGKFKG (SEQ ID NO: 71) |
| CD19 VH1 CDR3 | RETTTVGRYYYAMDY (SEQ ID NO: 72) |
| CD19 VH1 | QVQLQQSGAELVRPGSSVKISCKASGYAFSSYWMNWVK QRPGQGLEWIGQIWPGDGDTNYNGKFKGKATLTADESSS TAYMQLSSLASEDSAVYFCARRETTTVGRYYYAMDYWG QGTTVTVSS (SEQ ID NO: 73) |

TABLE 5-continued

CD19-Binding TCE Sequences

| | |
|---|---|
| CD19 VL2 CDR1 | RSSQSLLHKNAFNYLD (SEQ ID NO: 74) |
| CD19 VL2 CDR2 | LGSNRAS (SEQ ID NO: 75) |
| CD19 VL2 CDR3 | MQALQTPFT (SEQ ID NO: 76) |
| CD19 VL2 | DIVMTQSPLSLPVISGEPASISCRSSQSLLHKNAFNYLDWY LQKPGQSPQLLIYLGSNRASGVPDRFSGSGSGTDFTLKISR VEAEDVGVYYCMQALQTPFTFGCGTKVDIK (SEQ ID NO: 77) |
| CD19 VH2 CDR1 | SYGMH (SEQ ID NO: 78) |
| CD19 VH2 CDR2 | VISYEGSNKYYAESVKG (SEQ ID NO: 79) |
| CD19 VH2 CDR3 | DRGTIFGNYGLEV (SEQ ID NO: 80) |
| CD19 VH2 | QVQLVESGGGVVQPGRSLRLSCAASGFTFSSYGMHWVR QAPGKCLEWVAVISYEGSNKYYAESVKGRFTISRDNSKNT LYLQMNSLRDEDTAVYYCARDRGTIFGNYGLEVWGQGT TVTVSS (SEQ ID NO: 81) |
| CD19 VL3 CDR1 | RASQDVGTAV A (SEQ ID NO: 82) |
| CD19 VL3 CDR2 | WASTRHT (SEQ ID NO: 83) |
| CD19 VL3 CDR3 | QQYANFPLYT (SEQ ID NO: 84) |
| CD19 VL3 | EIVMTQSPAT LSVSPGERAT LSCRASQDVG TAVAWYQQKP GQAPRLLIYW ASTRHTGIPA RFSGSGSGTE FTLTISSLQS EDPAVYFCQQ YANFPLYTFG QGTKLEIK (SEQ ID NO: 85) |
| CD19 VH3 CDR1 | TYWIQ (SEQ ID NO: 86) |
| CD19 VH3 CDR2 | AVYPGDADTR YTQKFQG (SEQ ID NO: 87) |
| CD19 VH3 CDR3 | DAGLEYYALD Y (SEQ ID NO: 88) |
| CD19 VH3 | QVQLVQSGAE VKKPGASVKV SCKASGYTFT TYWIQWVRQA PGQRLEWMGA VYPGDADTRY TQKFQGRVTL TADRSASTAY MELSSLRSED TAVYYCGRDA GLEYYALDYW GQGTLVTVSS (SEQ ID NO: 89) |

In some embodiments, a CD3-targeted scFv comprises (a) a heavy chain variable region (VH) comprising a VH complementarity determining region (CDR)1 comprising a sequence that is at least 95% identical to a VH CDR1 amino acid sequence set forth in Table 6; a VH CDR2 comprising a sequence that is at least 95% identical to a VH CDR2 amino acid sequence set forth in Table 6, and a VH CDR3 comprising a sequence that is at least 95% identical to a VH CDR3 amino acid sequence set forth in Table 6; and (b) a light chain variable region (VL) comprising a VL CDR1 comprising a sequence that is at least 95% identical to a VL CDR1 amino acid sequence set forth in Table 6, a VL CDR2 comprising a sequence that is at least 95% identical to a VL CDR2 amino acid sequence set forth in Table 6, and a VL CDR3 comprising a sequence that is at least 95% identical to a VL CDR3 amino acid sequence set forth in Table 6.

In some embodiments, a CD3-targeted scFv comprises a VH comprising or consisting of an amino acid sequence having at least 95% sequence identity to a VH amino acid sequence set forth in Table 6, and a VL comprising or consisting of an amino acid sequence having at least 95% sequence identity to a VL amino acid sequence set forth in Table 6.

In some embodiments, the CD3-targeted scFv comprises any one of the following:

a variable light chain region having CDR1, CDR2, and CDR3 regions comprising SEQ ID NOs: 90-92 and a variable light chain region having CDR1, CDR2, and CDR3 regions comprising SEQ ID NOs: 94-96;

a variable light chain region having CDR1, CDR2, and CDR3 regions comprising SEQ ID NOs: 98-100 and a variable light chain region having CDR1, CDR2, and CDR3 regions comprising SEQ ID NOs: 102-104;

a variable light chain region having CDR1, CDR2, and CDR3 regions comprising SEQ ID NOs: 106-108 and a variable light chain region having CDR1, CDR2, and CDR3 regions comprising SEQ ID NOs: 110-112;

a variable light chain region comprising SEQ ID NO: 93 and a variable heavy region comprising SEQ ID NO: 97;

a variable light chain region comprising SEQ ID NO: 101 and a variable heavy region comprising SEQ ID NO: 105; and a variable light chain region comprising SEQ ID NO: 109 and a variable heavy region comprising SEQ ID NO: 113.

TABLE 6

| | CD3-Binding Portion TCE Sequences |
|---|---|
| CD3 VL1 CDR1 | RASSSVSYMN (SEQ ID NO: 90) |
| CD3 VL1 CDR2 | DTSKVAS (SEQ ID NO: 91) |
| CD3 VL1 CDR3 | QQWSSNPLT (SEQ ID NO: 92) |
| CD3 VL1 | VDDIQLTQSPAIMSASPGEKVTMTCRASSSVSYMNWYQQ KSGTSPKRWIYDTSKVASGVPYRFSGSGSGTSYSLTISSME AEDAATYYCQQWSSNPLTFGAGTKLELK (SEQ ID NO: 93) |
| CD3 VH1 CDR1 | RYTMH (SEQ ID NO: 94) |
| CD3 VH1 CDR2 | YINPSRGYTNYNQKFKD (SEQ ID NO: 95) |
| CD3 VH1 CDR3 | YYDDHYCLDY (SEQ ID NO: 96) |
| CD3 VH1 | DIKLQQSGAELARPGASVKMSCKTSGYTFTRYTMHWVK QRPGQGLEWIGYINPSRGYTNYNQKFKDKATLTTDKSSST AYMQLSSLTSEDSAVYYCARYYDDHYCLDYWGQGTTLT VSS (SEQ ID NO: 97) |
| CD3 VL2 CDR1 | RSSTGAVTTSNYAN (SEQ ID NO: 98) |
| CD3 VL2 CDR2 | GTNKRAP (SEQ ID NO: 99) |
| CD3 VL2 CDR3 | ALWYSNLWV (SEQ ID NO: 100) |
| CD3 LC2 (VL2) | QTVVTQEPSL TVSPGGTVTL TCRSSTGAVT TSNYANWVQQ KPGQAPRGLI GGTNKRAPGT PARFSGSLLG GKAALTLSGV QPEDEAEYYC ALWYSNLWVF GGGTKLTVLG QPKAAPSVTL FPPSSEELQA NKATLVCLIS DFYPGAVTVA WKADSSPVKA GVETTTPSKQ SNNKYAASSY LSLTPEQWKS HRSYSCQVTH EGSTVEKTVA PTECS (SEQ ID NO: 101) |
| CD3 VH2 CDR1 | TYAMN (SEQ ID NO: 102) |
| CD3 VH2 CDR2 | RIRSKYNNYATYYAASVKG (SEQ ID NO: 103) |
| CD3 VH2 CDR3 | HGNFGNSYVSWFAY (SEQ ID NO: 104) |
| CD3 HC2 (VH2) | EVQLVESGGG LVQPGGSLRL SCAASGFTFN TYAMNWVRQA PGKGLEWVAR IRSKYNNYAT YYAASVKGRF TISRDDSKNS LYLQMNSLKT EDTAVYYCAR HGNFGNSYVS WFAYWGQGTL VTVSSASTKG PSVFPLAPCS RSTSESTAAL GCLVKDYFPE PVTVSWNSGA LTSGVHTFPA VLQSSGLYSL SSVVTVPSSS LGTKTYTCNV DHKPSNTKVD KRVESKYGPP CPPCPAPEAA GGPSVFLFPP KPKDTLMISR TPEVTCVVVD VSQEDPEVQF NWYVDGVEVH NAKTKPREEQ FNSTYRVVSV LTVLHQDWLN GKEYKCKVSN KGLPSSIEKT ISKAKGQPRE PQVYTLPPSQEEMTKNQVSL TCLVKGFYPSDIAVEWESNGQPENNYKTTPPVLDSDGSFL LYSKLTVDKSRWQEGNVFSCSVMHEALHNHYTQKSLSLS L GK (SEQ ID NO: 105) |
| CD3 VL3 CDR1 | RSSTGAVTTS NYAN (SEQ ID NO: 106) |
| CD3 VL3 CDR2 | GTNKRAP (SEQ ID NO: 107) |
| CD3 VL3 CDR3 | ALWYSNLWV (SEQ ID NO: 108) |
| CD3 VL3 | QAVVTQEPSL TVSPGGTVTL TCRSSTGAVT TSNYANWVQQ KPGQAPRGLI GGTNKRAPWT PARFSGSLLG DKAALTLSGA QPEDEAEYFC ALWYSNLWVF GGGTKLTVL (SEQ ID NO: 109) |
| CD3 VH3 CDR1 | TYAMN (SEQ ID NO: 110) |
| CD3 VH3 CDR2 | RIRSKYNNYA TYYADSVKD (SEQ ID NO: 111) |
| CD3 VH3 CDR3 | HGNFGNSYVS WFAY (SEQ ID NO: 112) |
| CD3 VH3 | EVQLVESGGG LVQPGGSLKL SCAASGFTFN TYAMNWV RQA SGKGLEWVGR IRSKYNNYATYYADSVKDRF TISRD DSKST LYLQMNSLKT EDTAVYYCVR HGNFGNSYVS WF AYWGQGTL VTVSS (SEQ ID NO: 113) |

TABLE 6-continued

CD3-Binding Portion TCE Sequences

| | |
|---|---|
| CD3 scFv 3 | EVQLVESGGG LVQPGGSLKL SCAASGFTFN TYAMNWV RQA SGKGLEWVGR IRSKYNNYAT YYADSVKDRF TISRDDSKST LYLQMNSLKT EDTAVYYC VR HGNFGNSYVS WFAYWGQGTL VTVSSGGGGS GGGGSGGGGS GGGGSQAVVT QEPSLTVS PG GTVTLTCRSS TGAVTTSNYA NWVQQKPGQA PRGLIGGTNK RAPWTPARFS GSLLGDK AAL TLSGAQPEDE AEYFCALWYS NLWVFGGGTK LTVL (SEQ ID NO: 114) |
| CD3 VL4 CDR1 | RSSTGAVTTS NYAN (SEQ ID NO: 115) |
| CD3 VL4 CDR2 | GTNKRAP (SEQ ID NO: 116) |
| CD3 VL4 CDR3 | ALWYSNLWV (SEQ ID NO: 117) |
| CD3 VL4 | QTVVTQEPSLTVSPGGTVTLTCRSSTGAVTTSNYANWFQQ KPGQAPRGLIGGTNKRAPGVPARFSGSLLGGKAALTLSGV QPEDEAEYYCALWYSNLWVFGGGTKVEIK (SEQ ID NO: 118) |
| CD3 VH4 CDR1 | TYAMN (SEQ ID NO: 119) |
| CD3 VH4 CDR2 | RIRSKYNNYA TYYADSVKD (SEQ ID NO: 120) |
| CD3 VH4 CDR3 | HGNFGNSYVS WAAY (SEQ ID NO: 121) |
| CD3 VH4 | QVQLVESGGGVVQPGRSLRLSCAASGFTFSTYAMNWVR QAPGKGLEWVARIRSKYNNYATYYADSVKDRFTISRDDS KNTLYLQMNSLRAEDTAVYYCARHGNFGNSYVSWAAYW GQGTLVTVSS (SEQ ID NO: 122) |
| CD3 VL5 CDR1 | GSSTGAVTSG NYPN (SEQ ID NO: 123) |
| CD3 VL5 CDR2 | GTKFLAP (SEQ ID NO: 124) |
| CD3 VL5 CDR3 | VLWYSNRWV (SEQ ID NO: 125) |
| CD3 VL5 | QTVVTQEPSLTVSPGGTVTLTCGSSTGAVTSGNYPNWVQ QKPGQAPRGLIGGTKFLAPGTPARFSGSLLGGKAALTLSG VQPEDEAEYYCVLWYSNRWVFGGGTKLTVL (SEQ ID NO: 126) |
| CD3 VH5 CDR1 | KYAMN (SEQ ID NO: 127) |
| CD3 VH5 CDR2 | RIRSKYNNYA TYYADSVKD (SEQ ID NO: 128) |
| CD3 VH5 CDR3 | HGNFGNSYIS YWAY (SEQ ID NO: 129) |
| CD3 VH5 | EVQLVESGGGLVQPGGSLKLSCAASGFTFNKYAMNWVR QAPGKGLEWVARIRSKYNNYATYYADSVKDRFTISRDDS KNTAYLQMNNLKTEDTAVYYCVRHGNFGNSYISYWAYW GQGTLVTVSS (SEQ ID NO: 130) |

Combination Therapies (e.g., Chimeric Antigen Receptors (CAR) and CAR Immunotherapy)

In some embodiments, any of the methods described herein may comprise additional therapies (e.g., cancer treatments). In some embodiments, the methods herein further comprise administering to the subject an effective amount of a population of immune cells harboring a nucleic acid molecule encoding a chimeric antigen receptor targeted to HER2. In various embodiments, the methods described here include other methods known in the art for treating cancer; for example, the methods can further comprise administering an effective amount of one or more checkpoint inhibitors, such as an anti-PD-1 antibody (e.g., nivolumab, lambrolizumab, or pembrolizumab) or an anti-CTLA-4 antibody (e.g., ipilimumab). In some embodiments, the methods described here can further comprise administering a subject an effective amount of a chemotherapy.

Examples of clinical trials that include therapies combined with blinatumomab (a CD19-TCE) include:

ClinicalTrials.gov Identifier: NCT02879695, blinatumomab can be given with nivolumab alone or nivolumab and ipilimumab in treating patients (e.g., subjects with poor-risk CD19+ precursor B-lymphoblastic leukemia that has come back after a period of improvement (relapsed) or has not responded to treatment (refractory));

ClinicalTrials.gov Identifier: NCT03512405, Pembrolizumab and Blinatumomab in Treating Participants With Recurrent or Refractory Acute Lymphoblastic Leukemia;

ClinicalTrials.gov Identifier: NCT02997761, Ibrutinib and Blinatumomab in Treating Patients With Relapsed or Refractory B Acute Lymphoblastic Leukemia;

27

ClinicalTrials.gov Identifier: NCT02568553, Lenalido-
mide and Blinatumomab for the Treatment of Relapsed
Non-Hodgkin Lymphoma;

ClinicalTrials.gov Identifier: NCT03263572, Blinatumo-
mab, Methotrexate, Cytarabine, and Ponatinib in Treat-
ing Patients with Philadelphia Chromosome-Positive,
or BCR-ABL Positive, or Relapsed/Refractory, Acute
Lymphoblastic Leukemia;

ClinicalTrials.gov Identifier: NCT02143414, Blinatumo-
mab and Combination Chemotherapy or Dasatinib,
Prednisone, and Blinatumomab in Treating Older
Patients with Acute Lymphoblastic Leukemia;

ClinicalTrials.gov Identifier: NCT03914625 A Study to
Investigate Blinatumomab in Combination With Che-
motherapy in Patients With Newly Diagnosed B-Lym-
phoblastic Leukemia; etc.

In some embodiments, any of the methods described
herein further comprise administering to the subject an
effective amount of a population of immune cells expressing
a CAR or harboring a nucleic acid encoding a CAR. In some
embodiments, the CAR is targeted to HER2. In some
embodiments, a HER2 CAR comprises a scFv targeted to
HER2. In some embodiments, the solid tumor is a HER2-
expressing cancer. In some embodiment, the population of
immune cells expressing a CAR or harboring a nucleic acid
encoding a CAR is a population of HER2 CAR T cells. In
some embodiments, the population of immune cells express-
ing a CAR or harboring a nucleic acid encoding a CAR (e.g.,
HER2 CAR T cells) are autologous or allogeneic. In some
embodiments, the population of immune cells expressing a
CAR or harboring a nucleic acid encoding a CAR (e.g.,
HER2 CAR T cells) are administered simultaneously or
subsequently to administering to the subject a TCE
described herein (e.g., TCE-CD19). In some embodiments,
the HER2 CAR T cells are administered at least or about 0.1,
0.25, 0.5, 0.75, 1, 2, 3, 4, 5, 6, 7, 8, 9, 10, 11, 12, 13, 14, 15,
26, 17, 18, 19, or 20 days after administration of the TCE.
In some embodiments, the HER2 CAR T cells are admin-
istered at least or about 1, 2, 3, 4, 5, 6, 7, 8, 9, or 10 weeks
after administration of the TCE.

Useful HER2 CAR constructs are described in WO 2017/
079694.

In general, HER2 CAR include a HER2 scFv, a spacer
domain, a transmembrane domain, one or more co-stimula-
tory domains, and a CD3zeta cytoplasmic domain. For
example, a HER2 CAR can comprise or consist of the amino
acid sequence:

```
                                        (SEQ ID NO: 57)
DIQMTQSPSSLSASVGDRVTITCRASQDVNTAVAWYQQKPGKAPK

LLIYSASFLYSGVPSRFSGSRSGTDFTLTISSLQPEDFATYYCQQ

HYTTPPTFGQGTKVEIKGSTSGGGSGGGSGGGGSSEVQLVESGGG

LVQPGGSLRLSCAASGFNIKDTYIHWVRQAPGKGLEWVARIYPTN

GYTRYADSVKGRFTISADTSKNTAYLQMNSLRAEDTAVYYCSRWG

GDGFYAMDYWGQGTLVTVSSESKYGPPCPPCPAPEFEGGPSVFLF

PPKPKDTLMISRTPEVTCVVVDVSQEDPEVQFNWYVDGVEVHNAK

TKPREEQFQSTYRVVSVLTVLHQDWLNGKEYKCKVSNKGLPSSIE

KTISKAKGQPREPQVYTLPPSQEEMTKNQVSLTCLVKGFYPSDIA

VEWESNGQPENNYKTTPPVLDSDGSFFLYSRLTVDKSRWQEGNVF
```

28

```
-continued
SCSVMHEALHNHYTQKSLSLSLSLGKMFWVLVVVGGVLACYSLLVTV

AFIIFWVRSKRSRGGHSDYMNMTPRRPGPTRKHYQPYAPPRDFAA

YRSGGGRVKFSRSADAPAYQQGQNQLYNELNLGRREEYDVLDKRR

GRDPEMGGKPRRKNPQEGLYNELQKDKMAEAYSEIGMKGERRRGK

GHDGLYQGLSTATKDTYDALHMQALPPR,
``` or a variant thereof have 1, 2, 3, 4, 5, 6, 7, 8, 9, or 10 acid
modifications (e.g., substitutions), wherein the amino acid
modifications are not in the HER2 targeting domain (e.g.,
the CDRs of the HER2 scFv). A useful HER2 CAR can
comprise or consist of the amino acid sequence:

```
                                        (SEQ ID NO: 49)
DIQMTQSPSSLSASVGDRVTITCRASQDVNTAVAWYQQKPGKAPK

LLIYSASFLYSGVPSRFSGSRSGTDFTLTISSLQPEDFATYYCQQ

HYTTPPTFGQGTKVEIKGSTSGGGSGGGSGGGGSSEVQLVESGGG

LVQPGGSLRLSCAASGFNIKDTYIHWVRQAPGKGLEWVARIYPTN

GYTRYADSVKGRFTISADTSKNTAYLQMNSLRAEDTAVYYCSRWG

GDGFYAMDYWGQGTLVTVSSESKYGPPCPPCPAPEFEGGPSVFLF

PPKPKDTLMISRTPEVTCVVVDVSQEDPEVQFNWYVDGVEVHNAK

TKPREEQFQSTYRVVSVLTVLHQDWLNGKEYKCKVSNKGLPSSIE

KTISKAKGQPREPQVYTLPPSQEEMTKNQVSLTCLVKGFYPSDIA

VEWESNGQPENNYKTTPPVLDSDGSFFLYSRLTVDKSRWQEGNVF

SCSVMHEALHNHYTQKSLSLSLSLGKIYIWAPLAGTCGVLLLSLVIT

KRGRKKLLYIFKQPFMRPVQTTQEEDGCSCRFPEEEEGGCELGGG

RVKFSRSADAPAYQQGQNQLYNELNLGRREEYDVLDKRRGRDPEM

GGKPRRKNPQEGLYNELQKDKMAEAYSEIGMKGERRRGKGHDGLY

QGLSTATKDTYDALHMQALPPR,
``` or a variant thereof have 1, 2, 3, 4, 5, 6, 7, 8, 9, or 10 amino
acid modifications (e.g., substitutions), wherein the amino
acid modifications are not in the HER2 targeting domain
(e.g., the CDRs of the HER2 scFv).

(a) HER2 scFv

A useful HER2 scFv can comprise or consist of the amino
acid sequence:

```
                                        (SEQ ID NO: 60)
DIQMTQSPSSLSASVGDRVTITCRASQDVNTAVAWYQQKPGKAPK

LLIYSASFLYSGVPSRFSGSRSGTDFTLTISSLQPEDFATYYCQQ

HYTTPPTFGQGTKVEIKGGGGSGGGGSGGGGSEVQLVESGGGLVQ

PGGSLRLSCAASGFNIKDTYIHWVRQAPGKGLEWVARIYPTNGYT

RYADSVKGRFTISADTSKNTAYLQMNSLRAEDTAVYYCSRWGGDG

FYAMDYWGQGTLVTVSS
``` or is least 90%, 95%. 98%, 99% identical to SEQ ID NO: 60.
A HER2 scFv can comprise: a light chain variable domain
that is at least 90%, 95%, 98%, 99% or 100% identical to:

(SEQ ID NO: 61)
DIQMTQSPSSLSASVGDRVTITC<u>RASQDVNTAVA</u>WYQQKPGKAPK

LLIY<u>SASFLY</u>SGVPSRFSGSRSGTDFTLTISSLQPEDFATYYC<u>QQ</u>

<u>HYTTPPT</u>FGQGTKVEIK and comprises light chain CDRs 1-3 (underlined) and a heavy chain variable domain that is at least 90%, 95%, 98%, 99% or 100% identical to:

(SEQ ID NO: 62)
EVOLVESGGGLVQPGGSLRLSCAASGFNI<u>KDTYIH</u>WVRQAPGKGL

EWVA<u>RIYPTNGYTRYADSVKG</u>RFTISADTSKNTAYLQMNSLRAED

TAVYYCSR<u>WGGDGFYAMDY</u>WGQGTLVTVSS and comprises heavy chain CDRs 1-3 (underlined). In some embodiments, the light chain variable domain can precede the heavy chain variable domain and they can be joined by a linker that includes 5-20 amino acids, preferably G and S. In some embodiments, the heavy chain variable domain can precede the light chain variable domain and they can be joined by a linker that includes 5-20 amino acids, preferably G and S. Such linkers can comprise the sequence: GGGGSGGGGSGGGGS (SEQ ID NO: 58) or GGGGSGGGGS (SEQ ID NO: 59) and can be located between the VH and VL domains.

A useful scFv can target HER2. A useful HER2 scFv can comprise or consist of the amino acid sequence:

(SEQ ID NO: 63)
DIQMTQSPSSLSASVGDRVTITC<u>KASQDVSIGVA</u>WYQQKPGKAPK

LLIY<u>SASYRYT</u>GVPSRFSGSGSGTDFTLTISSLQPEDFATYYC<u>QQ</u>

<u>YYIYPYT</u>FGQGTKVEIKGGGGSGGGGSGGGGSEVQLVESGGGLVQ

PGGSLRLSCAASGFTF<u>TDYTMDW</u>VRQAPGKGLEWVA<u>DVNPNSGGS</u>

<u>IYNQRFKG</u>RFTLSVDRSKNTLYLQMNSLRAEDTAVYYCAR<u>NLGPS</u>

<u>FYFDY</u>WGQGTLVTVSS or is least 90%, 95%. 98%, 99% identical to SEQ ID NO:63. A HER2 scFv can comprise: a light chain variable domain that is at least 90%, 95%, 98%, 99% or 100% identical to:

(SEQ ID NO: 64)
DIQMTQSPSSLSASVGDRVTITC<u>KASQDVSIGVA</u>WYQQKPGKAPK

LLIY<u>SASYRYT</u>GVPSRFSGSGSGTDFTLTISSLQPEDFATYYC<u>QQ</u>

<u>YYIYPYT</u>FGQGTKVEIK and comprises light chain CDRs 1-3 (underlined) and a heavy chain variable domain that is at least 90%, 95%, 98%, 99% or 100% identical to:

(SEQ ID NO: 65)
EVQLVESGGGLVQPGGSLRLSCAASGFTF<u>TDYTMDW</u>VRQAPGKGL

EWVA<u>DVNPNSGGSIYNQRFKG</u>RFTLSVDRSKNTLYLQMNSLRAED

TAVYYCAR<u>NLGPSFYFDY</u>WGQGTLVTVSS and comprises heavy chain CDRs 1-3 (underlined). In some embodiments, the light chain variable domain can precede the heavy chain variable domain and they can be joined by a linker that includes 5-20 amino acids, preferably G and S.

In some embodiments, the heavy chain variable domain can precede the light chain variable domain and they can be joined by a linker that includes 5-20 amino acids, preferably G and S. Such linkers can comprise the sequence: GGGGSGGGGSGGGGS (SEQ ID NO: 58) or GGGGSGGGGS (SEQ ID NO: 59) and can be located between the VH and VL domains.

A CAR can comprise any scFv described herein or a variant thereof having 1-5 (e.g., 1 or 2) amino acid modifications (e.g., substitutions); a transmembrane domain selected from: a CD4 transmembrane domain or variant thereof having 1-5 (e.g., 1 or 2) amino acid modifications (e.g., substitutions), a CD8 transmembrane domain or variant thereof having 1-5 (e.g., 1 or 2) amino acid modifications (e.g., substitutions), a CD28 transmembrane domain or a variant thereof having 1-5 (e.g., 1 or 2) amino acid modifications (e.g., substitutions), and a CD3 transmembrane domain or a variant thereof having 1-5 (e.g., 1 or 2) amino acid modifications (e.g., substitutions); a costimulatory domain (e.g., a CD28 co-stimulatory domain or a variant thereof having 1-5 (e.g., 1 or 2) amino acid modifications (e.g., substitutions); or a 4-1 BB co-stimulatory domain or a variant thereof having 1-5 (e.g., 1 or 2) amino acid modifications (e.g., substitutions); or both a CD28 co-stimulatory domain or a variant thereof having 1-5 (e.g., 1 or 2) amino acid modifications (e.g., substitutions) and a 4-1 BB co-stimulatory domain or a variant thereof having 1-5 (e.g., 1 or 2) amino acid modifications (e.g., substitutions); and a CD3 signaling domain or a variant thereof having 1-5 (e.g., 1 or 2) amino acid modifications.

(b) Transmembrane Domain

A CAR disclosed herein can contain a transmembrane domain, which can be a hydrophobic alpha helix that spans the membrane. As used herein, a transmembrane domain refers to any protein structure that is thermodynamically stable in a cell membrane, preferably a eukaryotic cell membrane.

The transmembrane domain of a CAR as provided herein can be a CD28(M) transmembrane domain having the sequence: MFWVLVVVGGVLACYSLLVTVAFIIFWV (SEQ ID NO: 17). Other transmembrane domains can be used including those shown below in Table 1.

TABLE 1

| Examples of Transmembrane Domains | | | |
|---|---|---|---|
| Name | Accession | Length | Sequence |
| CD3z | J04132.1 | 21 aa | LCYLLDGILFIYGVILTALFL (SEQ ID NO: 15) |
| CD28 | NM_006139 | 27 aa | FWVLVVVGGVLACYSLLVTVA FIIFWV (SEQ ID NO: 16) |
| CD28(M) | NM_006139 | 28 aa | MFWVLVVVGGVLACYSLLVTV AFIIFWV (SEQ ID NO: 17) |
| CD4 | M35160 | 22 aa | MALIVLGGVAGLLLFIGLGIF F (SEQ ID NO: 18) |
| CD8tm | NM_001768 | 21 aa | IYIWAPLAGTCGVLLLSLVIT (SEQ ID NO: 19) |
| CD8tm2 | NM_001768 | 23 aa | IYIWAPLAGTCGVLLLSLVIT LY (SEQ ID NO: 20) |

TABLE 1-continued

Examples of Transmembrane Domains

| Name | Accession | Length | Sequence |
|------|-----------|--------|----------|
| CD8tm3 | NM_001768 | 24 aa | IYIWAPLAGTCGVLLLSLVIT LYC (SEQ ID NO: 21) |
| 4-1BB | NM_001561 | 27 aa | IISFFLALTSTALLFLLFFLT LRFSVV (SEQ ID NO: 22) |
| NKG2D | NM_007360 | 21 aa | PFFFCCFIAVAMGIRFIIMVA (SEQ ID NO: 23) |

(c) Spacer Domain

A HER2 CAR described herein can include a spacer located between the HER2 targeting domain (i.e., a HER2 targeted scFv or functional variant thereof) and the transmembrane domain. Without being bound by theory, the spacer can function to provide flexibility to the CAR, or domains thereof, or to prevent steric hindrance of the CAR, or domains thereof. A variety of different spacers can be used. Some of them include at least portion of a human Fc region, for example a hinge portion of a human Fc region or a CH3 domain, or variants thereof. Table 2 below provides various spacers that can be used in the CARs or polypeptides described herein.

TABLE 2

Examples of Spacer Domains

| Name | Length | Sequence |
|------|--------|----------|
| a3 | 3 aa | AAA |
| linker | 10 aa | GGGSSGGGSG (SEQ ID NO: 24) |
| IgG4 hinge (S→P) (S228P) | 12 aa | ESKYGPPCPPCP (SEQ ID NO: 25) |
| IgG4 hinge | 12 aa | ESKYGPPCPSCP (SEQ ID NO: 26) |
| IgG4 hinge (S228P) + linker Also called HL | 22 aa | ESKYGPPCPPCPGGGSSGGGSG (SEQ ID NO: 27) |
| CD28 hinge | 39 aa | IEVMYPPPYLDNEKSNGTIIHVKGKHLCPSPLFPGPSKP (SEQ ID NO: 28) |
| CD8 hinge-48aa | 48 aa | AKPTTTPAPRPPTPAPTIASQPLSLRPEACRPAAGGAV HTRGLDFACD (SEQ ID NO: 29) |
| CD8 hinge-45aa | 45 aa | TTTPAPRPPTPAPTIASQPLSLRPEACRPAAGGAVHTR GLDFACD (SEQ ID NO: 30) |
| IgG4 (HL-CH3) Also called: IgG4(HL-ΔCH2) (includes S228P in hinge) | 129 aa | ESKYGPPCPPCPGGGSSGGGSGGQPREPQVYTLPPSQ EEMTKNQVSLTCLVKGFYPSDIAVEWESNGQPENNYK TTPPVLDSDGSFFLYSRLTVDKSRWQEGNVFSCSVMH EALHNHYTQKSLSLSLGK (SEQ ID NO: 31) |
| IgG4 (L235E,N297Q) | 229 aa | ESKYGPPCPSCPAPEFEGGPSVFLFPPKPKDTLMISRT PEVTCVVVDVSQEDPEVQFNWYVDGVEVHNAKTKPRE EQFQSTYRVVSVLTVLHQDWLNGKEYKCKVSNKGLPS SIEKTISKAKGQPREPQVYTLPPSQEEMTKNQVSLTC LVKGFYPSDIAVEWESNGQPENNYKTTPPVLDSDGSF FLYSRLTVDKSRWQEGNVFSCSVMHEALHNHYTQKSL SLSLGK (SEQ ID NO: 32) |
| IgG4(S228P, L235E,N297Q) | 229 aa | ESKYGPPCPPCPAPEFEGGPSVFLFPPKPKDTLMISRT PEVTCVVVDVSQEDPEVQFNWYVDGVEVHNAKTKPRE EQFQSTYRVVSVLTVLHQDWLNGKEYKCKVSNKGLPS SIEKTISKAKGQPREPQVYTLPPSQEEMTKNQVSLTC LVKGFYPSDIAVEWESNGQPENNYKTTPPVLDSDGSF FLYSRLTVDKSRWQEGNVFSCSVMHEALHNHYTQKSL SLSLGK (SEQ ID NO: 33) |
| IgG4(CH3) Also called IgG4 (ΔCH2) | 107 aa | GQPREPQVYTLPPSQEEMTKNQVSLTCLVKGFYPSDI AVEWESNGQPENNYKTTPPVLDSDGSFFLYSRLTVDK SRWQEGNVFSCSVMHEALHNHYTQKSLSLSLGK (SEQ ID NO: 34) |

Some spacer regions include all or part of an immunoglobulin (e.g., IgG1, IgG2, IgG3, IgG4) hinge region, i.e., the sequence that falls between the CH1 and CH2 domains of an immunoglobulin, e.g., an IgG4 Fe hinge or a CD8 hinge. Some spacer regions include an immunoglobulin CH3 domain (called CH3 or ΔCH2) or both a CH3 domain and a CH2 domain. The immunoglobulin derived sequences can include one or more amino acid modifications, for example, 1, 2, 3, 4 or 5 substitutions, e.g., substitutions that reduce off-target binding.

The hinge/linker region can also comprise an IgG4 hinge region having the sequence ESKYGPPCPSCP (SEQ ID NO: 26) or ESKYGPPCPPCP (SEQ ID NO: 25).

The hinge/linger region can also comprise the sequence ESKYGPPCPPCP (SEQ ID NO: 25) followed by the linker sequence GGGSSGGGSG (SEQ ID NO: 24) followed by IgG4 CH3 (HL-CH3) sequence GQPREPQVYTLPP-SQEEMTKNQVSLTCLVKGFYPSDIAVEWESNGQPEN-NYKTT PPVLDSDGSFFLY-SRLTVDKSRWQEGNVFSCSVMHEALHNHYTQKSL SLSLGK (SEQ ID NO: 34). Thus, the entire linker/spacer region can comprise the sequence: ESKY-GPPCPPCPGGGSSGGGSGGQPREPQVYTLPP-SQEEMTKNQVSLTCLVKGFY PSDIAVEWESNGQPEN-NYKTTPPVLDSDGSFFLYSRLTVDKSRWQEGNVFSC-SV MHEALHNHYTQKSLSLSLGK (SEQ ID NO: 31). In some cases, the spacer has 1, 2, 3, 4, or 5 single amino acid changes (e.g., conservative changes) compared to SEQ ID NO: 31. In some cases, the IgG4 Fc hinge/linker region that is mutated at two positions (L235E; N297Q) in a manner that reduces binding by Fc receptors (FcRs).

(d) Intracellular Signaling Domains

A CAR construct described herein contains one or more intracellular signaling domains (e.g., CD3ζ, and optionally one or more co-stimulatory domains), which are the functional end of the receptor. Following antigen recognition, receptors cluster and a signal is transmitted to the cell.

CD3ζ is the cytoplasmic signaling domain of the T cell receptor complex. CD3ζ contains three immunoreceptor tyrosine-based activation motifs (ITAMs), which transmit an activation signal to the T cell after the T cell is engaged with a cognate antigen. In some cases, CD3ζ provides a primary T cell activation signal but not a fully competent activation signal, which requires a co-stimulatory signal.

Accordingly, in some examples, the CAR constructs disclosed herein may further comprise one or more co-stimulatory signaling domains in addition to CD3ζ. For example, the co-stimulatory domain CD28 and/or 4-1BB can be used to transmit a proliferative/survival signal together with the primary signaling mediated by CD3ζ.

The co-stimulatory domain(s) are located between the transmembrane domain and the CD3ζ signaling domain. Table 3 includes examples of suitable co-stimulatory domains together with the sequence of the CD3ζ signaling domain.

TABLE 3

| CD3ζ Domain and Examples of Co-stimulatory Domains | | | |
|---|---|---|---|
| Name | Accession | Length | Sequence |
| CD3ζ | J04132.1 | 113 aa | RVKFSRSADAPAYQQGQNQLYNELNLGRREEYDVLDKRRGR DPEMGGKPRRKNPQEGLYNELQKDKMAEAYSEIGMKGERR RGKGHDGLYQGLSTATKDTYDALHMQALPPR (SEQ ID NO: 35) ITAMS 1-3 underlined |
| CD3ζ variant | | 113 aa | RVKFSRSADAPAYQQGQNQLYNELNLGRREEYDVLDKRRGR DPEMGGKPRRKNPQEGLFNELQKDKMAEAFSEIGMKGERR RGKGHDGLFQGLSTATKDTFDALHMQALPPR (SEQ ID NO: 50) |
| CD3ζ variant | | 113 aa | RVKFSRSADAPAYQQGQNQLYNELNLGRREEYDVLDKRRGR DPEMGGKPRRKNPQEGLFNELQKDKMAEAFSEIGMKGERR RGKGHDGLYQGLSTATKDTYDALHMQALPPR (SEQ ID NO: 51) |
| CD3ζ variant | | 113 aa | RVKFSRSADAPAYQQGQNQLYNELNLGRREEYDVLDKRRGR DPEMGGKPRRKNPQEGLYNELQKDKMAEAYSEIGMKGERR RGKGHDGLFQGLSTATKDTFDALHMQALPPR (SEQ ID NO: 52) |
| CD3ζ variant | | 113 aa | RVKFSRSADAPAYQQGQNQLYNELNLGRREEYDVLDKRRGR DPEMGGKPRRKNPQEGLYNELQKDKMAEAFSEIGMKGERR RGKGHDGLFQGLSTATKDTFDALHMQALPPR (SEQ ID NO: 53) |
| CD3ζ variant | | 113 aa | RVKFSRSADAPAYQQGQNQLYNELNLGRREEYDVLDKRRGR DPEMGGKPRRKNPQEGLFNELQKDKMAEAYSEIGMKGERR RGKGHDGLFQGLSTATKDTFDALHMQALPPR (SEQ ID NO: 54) |
| CD3ζ variant | | 113 aa | RVKFSRSADAPAYQQGQNQLYNELNLGRREEYDVLDKRRGR DPEMGGKPRRKNPQEGLFNELQKDKMAEAFSEIGMKGERR RGKGHDGLYQGLSTATKDTFDALHMQALPPR (SEQ ID NO: 55) |
| CD3ζ variant | | 113 aa | RVKFSRSADAPAYQQGQNQLYNELNLGRREEYDVLDKRRGR DPEMGGKPRRKNPQEGLFNELQKDKMAEAFSEIGMKGERR RGKGHDGLFQGLSTATKDTYDALHMQALPPR (SEQ ID NO: 56) |

TABLE 3-continued

| CD3ζ Domain and Examples of Co-stimulatory Domains | | | |
|---|---|---|---|
| Name | Accession | Length | Sequence |
| CD28 | NM_006139 | 42 aa | RSKRSRLLHSDYMNMTPRRPGPTRKHYQPYAPPRDFAAYRS (SEQ ID NO: 36) |
| CD28gg * | NM_006139 | 42 aa | RSKRSRGGHSDYMNMTPRRPGPTRKHYQPYAPPRDFAAYR S (SEQ ID NO: 37) |
| 41BB | NM_001561 | 42 aa | KRGRKKLLYIFKQPFMRPVQTTQEEDGCSCRFPEEEEGGCEL (SEQ ID NO: 38) |
| OX40 | NM_003327 | 42 aa | ALYLLRRDQRLPPDAHKPPGGGSFRTPIQEEQADAHSTLAKI (SEQ ID NO: 39) |
| 2B4 | NM_016382 | 120 aa | WRRKRKEKQSETSPKEFLTIYEDVKDLKTRRNHEQEQTFPGG GSTIYSMIQSQSSAPTSQEPAYTLYSLIQPSRKSGSRKRNHS PSFNSTIYEVIGKSQPKAQNPARLSRKELENFDVYS (SEQ ID NO: 40) |

In some examples, the CD3ζ signaling domain comprises an amino acid sequence that is at least 90%, at least 95%, at least 98% identical to SEQ ID NO: 35. In such instances, the CD3ζ signaling domain has 1, 2, 3, 4, or 5 amino acid changes (preferably conservative substitutions) compared to SEQ ID NO: 35. In other examples, the CD3ζ signaling domain is SEQ ID NO: 35.

In various embodiments: the co-stimulatory domain is selected from the group consisting of: a co-stimulatory domain depicted in Table 3 or a variant thereof having 1-5 (e.g., 1 or 2) amino acid modifications, a CD28 co-stimulatory domain or a variant thereof having 1-5 (e.g., 1 or 2) amino acid modifications, a 4-1BB co-stimulatory domain or a variant thereof having 1-5 (e.g., 1 or 2) amino acid modifications and an OX40 co-stimulatory domain or a variant thereof having 1-5 (e.g., 1 or 2) amino acid modifications. In certain embodiments, a 4-1BB co-stimulatory domain or a variant thereof having 1-5 (e.g., 1 or 2) amino acid modifications is present in the CAR polypeptides described herein.

In some embodiments, there are two co-stimulatory domains, for example, a CD28 co-stimulatory domain or a variant thereof having 1-5 (e.g., 1 or 2) amino acid modifications (e.g., substitutions) and a 4-1BB co-stimulatory domain or a variant thereof having 1-5 (e.g., 1 or 2) amino acid modifications (e.g., substitutions). In various embodiments the 1-5 (e.g., 1 or 2) amino acid modification are substitutions. In various embodiments, the co-stimulatory domain is amino terminal to the CD3ζ signaling domain and a short linker consisting of 2-10, e.g., 3 amino acids (e.g., GGG) can be positioned between the co-stimulatory domain and the CD3ζ signaling domain.

In various embodiments: the costimulatory domain is selected from the group consisting of: a CD28 costimulatory domain or a variant thereof having 1-5 (e.g., 1 or 2 acid modifications, a 4-1BB costimulatory domain or a variant thereof having 1-5 (e.g., 1 or 2) amino acid modifications and an OX40 costimulatory domain or a variant thereof having 1-5 (e.g., 1 or 2) amino acid modifications. In certain embodiments, a 4-1BB costimulatory domain or a variant thereof having 1-5 (e.g., 1 or 2) amino acid modifications in present. In some embodiments there are two costimulatory domains, for example a CD28 co-stimulatory domain or a variant thereof having 1-5 (e.g., 1 or 2) amino acid modifications (e.g., substitutions) and a 4-1 BB co-stimulatory domain or a variant thereof having 1-5 (e.g., 1 or 2) amino acid modifications (e.g., substitutions). In various embodiments the 1-5 (e.g., 1 or 2) amino acid modification are substitutions.

In some cases there is a short sequence of 1-6 amino acids (e.g. GGG) between the co-stimulatory domains and the CD3 signaling domain and/or between the two co-stimulatory domains.

Also disclosed is a population of human T cells transduced by a vector comprising an expression cassette encoding a chimeric antigen receptor, wherein chimeric antigen receptor comprises: an scFv targeted to HER2; a transmembrane domain selected from: a CD4 transmembrane domain or variant thereof having 1-5 amino acid modifications (e.g., 1 or 2) amino acid modifications (e.g., substitutions), a CD8 transmembrane domain or variant thereof having 1-5 amino acid modifications (e.g., 1 or 2) amino acid modifications (e.g., substitutions), a CD28 transmembrane domain or a variant thereof having 1-5 amino acid modifications (e.g., 1 or 2) amino acid modifications (e.g., substitutions), and a CD34 transmembrane domain or a variant thereof having 1-5 amino acid modifications (e.g., 1 or 2) amino acid modifications (e.g., substitutions); a costimulatory domain (e.g., a CD28 co-stimulatory domain or a variant thereof having 1-5 (e.g., 1 or 2) amino acid modifications (e.g., substitutions); or a 4-1BB co-stimulatory domain or a variant thereof having 1-5 (e.g., 1 or 2) amino acid modifications (e.g., substitutions); or both a CD28 co-stimulatory domain or a variant thereof having 1-5 (e.g., 1 or 2) amino acid modifications (e.g., substitutions) and a 4-1BB co-stimulatory domain or a variant thereof having 1-5 (e.g., 1 or 2) amino acid modifications (e.g., substitutions); and CD3ζ signaling domain of a variant thereof having 1-5 amino acid modifications (e.g., 1 or 2) amino acid modifications (e.g., substitutions).

In various embodiments: the population of human T cells comprises central memory T cells (TCM cells) e.g., at least 20%, 30%, 40%, 50% 60%, 70%, 80% of the cells are TCM cells, or the population of T cells comprises a combination of central memory T cells, naive T cells and stem central memory cells ($T_{CM/SCM/N}$ cells) e.g., at least 20%, 30%, 40%, 50% 60%, 70%, 80% of the cells are $T_{CM/SCM/N}$ cells. In either case, the population of T cells includes both CD4+ cells and CD8+ cells (e.g., at least 20% of the CD3+ T cells are CD4+ and at least 3% of the CD3+ T cells are CD8+ and at least 70, 80 or 90% are either CD4+ or CD8+; at least 15%, 20%, 25%, 30%, 35%, 40%, 50%, 60% of the cells CD3+ cells are CD4+ and at least 4%, 5%, 8%, 10%, 20 of the CD3+ cells are CD8+ cells).

The CAR can include a spacer region located between the tumor targeting domain (e.g., a scFv; e.g., a HER2 scFv) and the transmembrane domain. A variety of different spacers can be used. Some of them include at least portion of a human Fc region, for example a hinge portion of a human Fc region or a CH3 domain or variants thereof.

An "amino acid modification" refers to an amino acid substitution, insertion, and/or deletion in a protein or peptide sequence. An "amino acid substitution" or "substitution" refers to replacement of an amino acid at a particular position in a parent peptide or protein sequence with another amino acid. A substitution can be made to change an amino acid in the resulting protein in a non-conservative manner (i.e., by changing the codon from an amino acid belonging to a grouping of amino acids having a particular size or characteristic to an amino acid belonging to another grouping) or in a conservative manner (i.e., by changing the codon from an amino acid belonging to a grouping of amino acids having a particular size or characteristic to an amino acid belonging to the same grouping). Such a conservative change generally leads to less change in the structure and function of the resulting protein. The following are examples of various groupings of amino acids: 1) Amino acids with nonpolar R groups: Alanine, Valine, Leucine, Isoleucine, Proline, Phenylalanine, Tryptophan, Methionine; 2) Amino acids with uncharged polar R groups: Glycine, Serine, Threonine, Cysteine, Tyrosine, Asparagine, Glutamine; 3) Amino acids with charged polar R groups (negatively charged at pH 6.0): Aspartic acid, Glutamic acid; 4) Basic amino acids (positively charged at pH 6.0): Lysine, Arginine, Histidine (at pH 6.0). Another grouping may be those amino acids with phenyl groups: Phenylalanine, Tryptophan, and Tyrosine.

For amino acid positions in immunoglobulin discussed herein, numbering is according to the EU index or EU numbering scheme (Kabat et al. 1991 Sequences of Proteins of Immunological Interest, 5th Ed., United States Public Health Service, National Institutes of Health, Bethesda, hereby entirely incorporated by reference). The EU index or EU index as in Kabat or EU numbering scheme refers to the numbering of the EU antibody (Edelman et al. 1969 *Proc Natl Acad Sci USA* 63:78-85).

The methods described herein can further comprise administering a population of autologous or allogeneic human immune cells (e.g., macrophages, NK cells, NKT cells, T cells, subpopulations of each thereof, and combinations thereof). In some embodiments, useful autologous or allogenic T cells comprise central memory T cells (TCM cells) or a combination of central memory T cells, naive T cells, and stem central memory cells (i.e., the T cells are TCM/SCM/N cells). In some embodiments, the population of T cells includes both CD4+ cells and CD8+ cells. In some embodiments, the immune cells express a CAR or are transduced by a nucleic acid encoding a CAR (e.g., a HER2 CAR).

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

DESCRIPTION OF DRAWINGS

FIG. 1A) Schematic depicting combination therapy concept utilizing OV19t to introduce CD19t to solid tumors cells allowing for targeting of tumor cells by peripheral blood mononuclear cells (PBMC) with the addition of CD19-TCE. FIGS. 1B-1C) Quantification of (FIG. 1B) CD69 and (FIG. 1C) CD137 expression on human T cells following 24 hours co-culture with tumor cells at an effector:target (E:T) ratio of 1:1 with or without CD19-TCE and the indicated multiplicity of infection (MOI) of OV19t. FIG. 1D) IFNy (left) and IL-2 (right) production measured by enzyme-linked immunosorbent assay (ELISA) in supernatants collected from co-cultures with or without CD19-TCE with indicated MOI of OV19t after 24 hours. FIG. 1E) Tumor cell killing assay of MDA-MB-468 tumor cells visualized by phase-contrast microscopy with or without CD19-TCE in the presence of human T cells or CD19-CAR T cells and indicated MOI of OV19t. MDA-MB-468-CD19t cells were used as positive control. Images are shown. FIG. 1F) Quantification of MDA-MB-468 cell killing assessed by flow cytometry. Tumor cells were co-cultured with human T cells with or without CD19-TCE and indicated MOI of OV19t after 24 (left), 48 (middle), and 72 (right) hours. FIG. 1G) CD19t percentage on MDA-MB-468 tumor cells from FIG. 1F.

FIG. 2A) Quantification of CD137 on human T cells following 24 (left), 48 (middle), or 72 (right) hours following coculture with MDA-MB-468 tumor cells at an effector:target (E:T) ratio of 1:1 with or without BLINCYTOR or CD19-TCE and the indicated MOI of OV19t. FIG. 2B) Percent of CD19t expression on MDA-MB-468 tumor cells in killing assay described in FIG. 2A. FIG. 2C) Quantification of MDA-MB-468 cell killing assessed by flow cytometry.

FIG. 3A) Schematic depicting subcutaneous MDA-MB-468 tumor-bearing NSG mice ($5 \times 10^6$ cells on day 0) treated with IT OV19t ($1 \times 10^7$ pfu) on day 32, engrafted with IV PBMC expressing firefly luciferase (PBMC-ffluc) ($1 \times 10^7$ cells) on day 34, and treated with IV CD19-TCE (8 ug/dose, 8 times) on days 38-42 and 45-47. FIG. 3B) Flux imaging of mice on indicated days after engraftment with PBMC-ffluc only (left), OV19t with PBMC-ffluc (middle), and OV19t with PBMC-ffluc and CD19-TCE (right). FIG. 3C) Quantification of T cell flux at the tumor site. FIG. 3D) Schematic depicting subcutaneous MDA-MB-468 tumor-bearing NSG mice ($5 \times 10^6$ cells on day 0) treated with intratumoral (IT) OV19t ($1 \times 10^6$ pfu) on day 32, engrafted with intravenous (IV) PBMC ($1 \times 10^7$ cells) on day 34, and treated with IV CD19-TCE (100 ug/dose, 8 times) on days 38-42 and 45-47. FIG. 3E) Tumor volumes are shown as mean±SEM (n≥5 per group).

FIG. 4A) Protein L and CD3 expression on T cells preloaded with CD19-TCE (10 ug/mL) for 1 hour. FIG. 4B) Protein L and CD137 expression on T cells at 0.5, 4, 24, 48, and 72 hours following CD19-TCE preloading (10 ug/mL). FIG. 4C) Quantification of CD137 expression (left), tumor cell killing (middle), and CD19t expression (right) on CD19-TCE preloaded human T cells following 24 hours co-culture with MDA-MB-468 tumor cells at an E:T ratio of 1:1 with or without CD19-TCE and indicated MOI of OV19t. FIG. 4D) Schematic of tumor cell rechallenge killing assay (top). MDA-MB-468 tumor cells with or without HER2 expression (1:4 ratio) were plated and infected with OV19t at indicated MOI. human T cells or HER2-CAR T cells were added with or without CD19-TCE, and rechallenged with non-HER2 expressing MDA-MB-468 cells. CD137 expression, tumor cell killing, CD19t expression, and T cell counts were quantified using flow cytometry. FIG. 4E) Assay was performed as demonstrated in FIG. 4D with an additional rechallenge 48 hours after the first rechallenge, and CD137 expression, tumor cell killing, CD19t expression, and T cell counts at the lowest MOI (0.003125) of OV19t were quantified using flow cytometry.

(FIG. 5A) Quantification of MDA-MB-468 cells stably expressing CD19t co-cultured with T cells with or without CD19-TCE. (FIG. 5B) OV90 tumor cells were co-cultured with human T cells with or without CD19-TCE (0, 20, or 100 ng/mL) or CD19-CAR T cells and the indicated MOI of OV19t. Images were taken using phase-contrast microscopy.

(FIG. 6A) PC3, (FIG. 6B) U87, or (FIG. 6C) SNU-16 tumor cells were co-cultured with human T cells with or without CD19-TCE or CD19-CAR T cells and the indicated MOI of OV19t for 24 hours. CD137 expression was quantified by flow cytometry. Supernatants were collected and ELISA was used to detect levels of IFN-γ and IL-2. Tumor cell killing and CD19t expression were quantified using flow cytometry.

(FIG. 9A) Quantification of CD137 expression on CD19-TCE preloaded human T cells or T cells alone following 48 hours coculture with MDA-MB-468 tumor cells at an E:T ratio of 1:1 with or without CD19-TCE with the addition of indicated MOI of OV19t. (FIG. 9B) Tumor killing and (FIG. 9C) CD19t expression of MDA-MB-468 tumor cells in killing assay described in FIG. 9A.

FIGS. 11A-11BE provides the nucleotide sequence of an OV19t (SEQ ID NO:1). The sequence for the synthetic early promoter (pSE) and the sequence encoding the transgene, human truncated CD19 (CD19t also hCD19t), are underlined and identified on FIG. 11Y.

FIGS. 12A-12AU provides the nucleotide sequence for the parent strain OV (CF33; SEQ ID NO: 2). The J2R gene encoding thymidine kinase (tk) is underlined and identified.

Figure 1A:
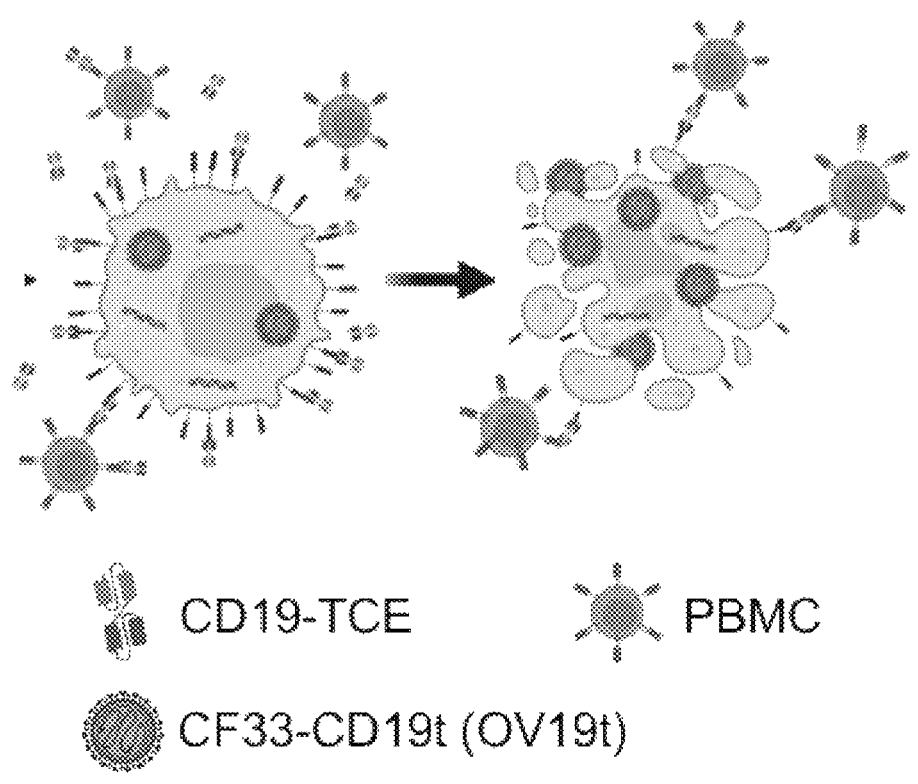
FIGS. 1A-1G. CD19-TCE redirects in vitro activation and cytotoxicity of human T cells against tumor cells infected with OV19t.

The nucleotides deleted for CD19t transgene insertion for OV19t are double underlined and identified ("[del]").

FIGS. 13A-13BL provides the nucleotide sequences for coding regions of OV19t. Genes 1-322 coincide with SEQ ID NOs: 131-322, respectively.

FIGS. 14A-14AB provides the amino acid sequences for proteins encoded by OV19t.

Protein 1-201 coincide with SEQ ID NOs: 453-653, respectively.

FIGS. 15A-15BH provides the nucleotide sequence of an OV19t (SEQ ID NO:5). The 5' ITR and the 3' ITR are underlined.

DETAILED DESCRIPTION

We previously developed a novel combination therapy for solid tumors by delivering a truncated CD19 antigen with an oncolytic virus (OV) followed by CD19-CAR T cells to mitigate antigen heterogeneity and elicit an immunologically warm TME [13]. The present application is directed to, inter alia, the ability of OV to deliver truncated CD19 to solid tumors to be targeted with bispecific T cell engagers (TCE) to induce endogenous T cell activation and anti-tumor responses. The current findings support a fully off-the-shelf therapeutic combination with immediate clinical applications. Further, we demonstrate that this paradigm can be advanced with two clinically active TCEs, with the prospect of additional tumor antigens that may be exploited for this combinatorial immunotherapy strategy.

Using a TCE rather than a CAR T cell carries several key advantages. Given the length of time required to generate patient-specific CD19-CAR T cells, we reasoned that the availability of off-the-shelf immunotherapies overcomes time restraints for patients undergoing treatment. With current manufacturing practices and capacities, the demand for CAR T cells exceeds supply and is still viewed as a niche technology that not all sites can perform [17]. Moreover, TCEs such as blinatumomab provide a safety advantage over CAR T cells due to the nature of their short in vivo half-life and dosing strategies [18, 19]. This treatment can then be suspended or delayed if needed, with the potential for reversing unfavorable immune-related adverse effects. Importantly, the proof-of-concept trial for the combination therapy using OV19t and blinatumomab is underway with recent FDA clearance.

TABLE 4

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF1:
MRDVRPEYWMGLDVAVFLFFATSDVDRHLTVFPSADSEMDLI

>ORF2:
MDSLRPVVVVRVHDVSLTGYRLISTSI

>ORF3:
MTTGDIILTLEGKSSSRIKAYLIQANNGSGYR

>ORF4:
MAVLIIERDVVTLAPYSNNRFANCILLTSTA

>ORF5:
MRRYIVMKRVLTHITVVHTGTKYVTGAVTF

>ORF6:
MVYVDLRTIYHRKVSHKYSCNGRCFCILLINIYKRRM

>ORF7:
MYILQVILGTHHHINTGNYILRNIKLVCICKMFRKWIFPHCFKMDGANNCHTSING

>ORF8:
MTRSLNRLCDARLLRLSSLRIIFMLVILL

>ORF9:
MYLSNSDFFSHVCVDTSLVIGDMCSASSTSDTLSIL

>ORF10:
MDFPIQSVHRQSIMTLTQQCMLYWQVLLSLR

>ORF11:
MIITYFEIRIKSQQHFSHMNIITHENTKIQMEWCITTII

>ORF12:
MLYKQRNNSLGLFYRYRFSTLTWFINVCETQIIIM

>ORF13:
MISVQSLTSSHGIFFTSSRMSMNTDSASSLKERSVEYNCPAHCLLRYA

>ORF14:
MDSNPSILSGRMTIILVSPTYGSSMIEKLPNDSFTDA

>ORF15:
MNTFSPFIEDAISLKISIVIDIGRVAR

>ORF16:
MSSFSILLTTIVLLELFMNNPPVTKIVLLTETADTLLFL

>ORF17:
MNTAISSFGIEIFGNYTQPYFQSPCFLFSLLTSSNRHGVDDRGEQKDYNQGPHLENG

>ORF18:
MQFYFVFVSLIKISYEYLVKLSMLRKVVTSFDVLPRNLVK

>ORF19:
MYKLIWSSYSVNVTVGGPIFTSTHSPVQYSSTL

>ORF20:
MESNPTSHDSVIIEIVYSLKFNTNSLLSSVYEFSILSTPSI

>ORF21:
MAYHIIQRHNQKLCTFSCMDFRISIYLFRRQHLDPKNDIPDHM

>ORF22:
MILRTRLPYTSRLVHFTKEGCLPYLIKVLMSLIQKTNWNTVLFFI

>ORF23:
MISISSKHFKIYHLYCCSDCTSIRVS

>ORF24:
MDDDNLRLCINDPFLLIFNTLSRKKIIIFVLASSIE

>ORF25:
MNRHVYLMSSFFSQKCTTQSLLICFSISFSISLR

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF26:
MNKYPPFVLVKDESIKGSCCRIRVLSCLAETDVCLTINRITKFD

>ORF27:
MRMHITAFFTIHNIKMIIYNRPHMAYSFQTFHEYIIHAVFLRGGYLDGAADIVEE
RFSVSFSPSLTFTRFGICSTAPFLNLILIISFPCTSTAVT

>ORF28:
MAVFPEPDGPLNMIDFTIPDIYVSQKSRLCSLFCIYVNVYYIYNM

>ORF29:
MTYINPFNIATPISHFGSRILAYFCQYGFDGFHLSILDVNDES

>ORF30:
MYSSSASPPQLERGYFSSGISYIQEFVHVLYAITFELLYGD

>ORF31:
MEILSCELLIPIDINSMLWYLGNDSSKNAILFKNVIHS

>ORF32:
MRISGAKSSFFIFNISSLKIFIIDSSVKYLKFSSLMSLKIFRNIVLNDADSIFLL
LYLSAYM

>ORF33:
MYFSHSVMADPICKKSAVERIYFTLSLVRLKGIP

>ORF34:
MTSIRIIGDCGICMRWAAFTFCVIVTITSNLGKFSRWTPITTLIMPLIKIFSLVT

>ORF35:
MNLTPRMHTICLMRLIVHRHLYPFL

>ORF36:
MSVISNPSKYKQSNTNKHMLEFLYSFFLCIPKLPNGSGTLCSSTRTISESNTIDV
AFLNAFGMYSLR

>ORF37:
MGLIGVITEIDIESRFCLDAFSIISFKLLDFLNTS

>ORF38:
MLLSRGRISVFSLKKVLIVSPIYPYPKSCSISS

>ORF39:
MIKYLSSLSVIKSLINLDFSLYPDA

>ORF40:
MRVRYAYRTRIRVLIPSCQSNMLHPFITLY

>ORF41:
MLSVCPRRYLHRLYRSLDSSDIGILSDICSANAIHLYFLFVNSQCLDTRLDRATT
ILESQHIISFTKLTKSNSPESESTLSFSLNNRSMSPYCLIAKSSSVINAE

>ORF42:
MDWFKVNNSSDIIVVYYTNSHYLVK

>ORF43:
MSGSNGRVRGYWWCRISRQVYSKTVN

>ORF44:
MEYADYILYLLHYRSYQNTNAHNIIPHPLNEI

>ORF45:
MSCMPIPALLTSSIWILSISSSSFKIDTTYEYYFLF

>ORF46:
MRGIISPGLILANVLLGIAARTFFVVL

>ORF47:
MAASSNLLFFEISSIILCHSAIVIYYICFLIRHLLE

>ORF48:
MDTFIIIAYPVSRTIFSNICIFYRFIY

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF49:
MLLVNHLLELRYPPCINHNHMVRQIFSIV

>ORF50:
MRSIFVLSVNVYSPAYYWIVDDDVTIYISYNY

>ORF51:
MRCTPHYLLSIGRIHFNGFGFGIEFKGMC

>ORF52:
MCIIPRASRRGRGTRNYCYFIIILDLILILFIRFFASSFISRYTTEFHKKRRE

>ORF53:
MLIFILSILPYNICSLIGTELYDCIFLYTKSNGCSRLQTCIKVSCSMLEFMYLAE
DIPIQFDGIGNCLLSMVIMEYHLLFANI

>ORF54:
MSFVNDVTNRLLGISALTTNMVVGPLLTTTHLLSGDMITA

>ORF55:
MGKVRIFLPLTSLSIEITHPPTELIQSIIVDNL

>ORF56:
MCSVLGAITLDSLSHIKLPAKLSSSNISFLE

>ORF57:
MSEVSSVAPSDADPSTYLTSSSDDSLHMSPIRTLNSRFLTHFVSTIVEPMISS

>ORF58:
MLDPSTGWVLMSLSFSSSLHLMSIDTSQSFHQRILRWI

>ORF59:
MIVSFFAFVNCLEEESLLLHLISKFRVHTFLL

>ORF60:
MTRPLIGSRLVSFLRSNRRRERHLVEQRFNHR

>ORF61:
MRQHCCYNFERRYYSIRLSECRTYLVDTVVY

>ORF62:
MMGVQSRLLRILVSAPRDKRAYTTRGLCLVYC

>ORF63:
MRRCIHIKERKIHMTNIVDRNVTFILTVVHKYVRYVPHTVANDAYNLVHLIMIYF
FIIKDVKEKQNNIFF

>ORF64:
MGKDPPSSLPWMETLLLIKHLITSLDRD

>ORF65:
MMKAIIPHKMIKSVVREHEGDLVFSSADMIQEGEIVVLVQNLSQHK

>ORF66:
MGPSMRNPQDVFSQTMSDVGHGIQGVLSSVAMTGSELGTRRGHCKGRPVAVYANR
GL

>ORF67:
MLYIPSMSSGSIITILEFPSYGISIIENPPNNSLICTYCKLFSVPTIISTLVTIF
LEI

>ORF68:
MDSGLVNKELILPFVIVLTHSLISSFVWLALLKFTV

>ORF69:
MSLLSSFLSSGVFSFIFSIYFDSCSAVEPAAP

>ORF70:
MSHTTYISSLCETTPGFIVPVQKLGNVFHILLTVLYLITLFEIFVSSSISMLFTV
CTDV

>ORF71:
MEFAFVYLHLVRLYHFRYTLITSCN

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF72:
MRSNYTLNTVTILCSYGTQIPTVTEFRCIVGYP

>ORF73:
MYHHFHRHLYYTALKYLYNISFFTHIA

>ORF74:
MYNISYIISEGSNVSRQFLSVKTGNSLSYTFDTYISL

>ORF75:
MVYGEFSLLSIMSCVACLLLSVNAFISPLIRIR

>ORF76:
MSRKFMQVYEYDREQYLDEFIEDRYNDSFITSPEYYSAEKYMCRYTTLNHNCINV
RRCALDSKLLHDIITNCKIYNNIELVRATKFVYYLDLIKCNWVSKVGDSVLYPVI
FITHTSTRNLDKVSVKTYKGVKVKKLNRCADHAIVINPFVKFKLTLPNKTSHAKV
LVTFCKLRTDITQIEAPLSGNVLVYTFPDINKRIPGYIHVNIEGCIDGMIYINSS
KFACVLKLHRSMYRIPPFPIDICSCCSQYTNDDIEIPIHDLIKDVAIFKNKETVY
YLKLNNKTIARFTYFNNIDTAITQEHEYVKIALGIVCKLMINNMHSIVGVNHSNT
FVNCLLEDNV

>ORF77:
MSAPYNICVYVTSNKCINIGTYHFASRSLIYYLWIRDKIYI

>ORF78:
MFLLFSISTFFSISSFSLSISFMISSTFVTSVSMLVVSNKTIG

>ORF79:
MIEGNRRTIIRDLILKMVRAYKGVNOCIICSFISFLYH

>ORF80:
MLQSVVQFLLRRIVPYNTLPLYNRLVQI

>ORF81:
MYIPSSLKALLYLSLARIIDTLLIISYIS

>ORF82:
MNSIPVPTLTETSRSFIIIPLSVSITHCLTRDSFGIVRTISSNGITAHLVNSLYI
LCNMALLLPYTINLLL

>ORF83:
MILILISYSDIYIYVIMYNRNCLLHLYKIHDLLKYIYRY

>ORF84:
MFERDYNPVLYGMWKNWNTRVLYNEEINIHSSQVFPF

>ORF85:
MNLIIRFSVSTTKLGLNHFKRGRSYIHRVRH

>ORF86:
MVIDTFSFHRTRKSSGMGHHKSKYIPIVFWLWLSFLNQMVRSI

>ORF87:
MIFYIISNWFRSRDFEYRRAIKIIYILWFLRTSFW

>ORF88:
MSTMNPDRVCRLYNKCIRHQPVPHN

>ORF89:
MFFISCLKKLSRGYTVNVVAIASSPGNVVSISY

>ORF90:
MMFIHCVVFPDLSNPSKTINAPRDIFVNLTYFLQFMRIIKLKINIWSSETIRSTF
IDHG

>ORF91:
MAVYAVTGGAGFLGRYIVKLLISADDVQEIRVIDIVEDPQPITSKVKVINYIQCD
INDFDKVREALDGVNLIIHTAALVDVFGKYTDNEIMKVNYYGTQTILAACVDLGI
KYLIYTSSMEAIGPNKHGDPFIGHEHTLYDISPGHVYAKSKRMAEQLVMKANNSV
IMNGAKLYTCCLRPTGIYGEGDKLTKVFYEQCKQHGNIMYRTVDDDAVHSRVYVG
NAAWMHVLAAKYIQYPGSKIKGNAYFCYDYSPSCSYDMFNLLLMKPLGIEQGSRI
PRWMLKMYACKNDMKRILFRKPSLLNNYTLKISNTTFEVRTNNAELDFNYSPIFN
VDVAFERTRKWLEESE

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF92:
MYSLLFIILMCIPFSFQTVYDDKSVCDSDNKEYMGIEVYVEATLDEHLRQTTCES
EIHKYGASVSNGGLNISVDLLNCFLNFHTVGVYTNRDTVYAKFASLDPWTTEPIN
SMTHDDLVKLTEECIVDIYLKCEVDKTKDFMKTNGNRLKPRDFKTVPPSDVGSMI
ELQSDYCVNDVTAYVKIYDECGNIKQHSIPTLRDYFTTKNGQPRKILKKKFDNC

>ORF93:
MSRVRISLIYLYTLVVITTTKTIEYTACNDTIIIPCTIDNPTKYIRWKLDNHDIL
TYNKTSKTTILSKWHTSARLHSLSDSDVSLIMEYKDILPGTYTCGDNTGIKSTVK
LVQLHTNWFNDYQTMLMFIFTGITLFLLFLEITYTSISVVFSTNLGILQVFGCVI
AMIELCGAFLFYPSMFTLRHIIGLLMMTLPSIFLIITKVFSFWLLCKLSCAVHLI
IYYQLAGYILTVLGLGLSLKECVDGTLLLSGLGTIMVSEHFSLLFLVCFPSTQRD
YY

>ORF94:
MTPLKRERENENENKNILVTPSERGLIFFMRPSKRERE

>ORF95:
MMSFTTSALYMMFLFSNTKSNTVFSRKVDVVSDV

>ORF96:
MGNFEIKLSSVLMLSTMESILSLFFTVSVMMDVSSFLYHLMSDSLRISICGVCFV

>ORF97:
MLLAELILRCFYKVSRLRERVTVEQS

>ORF98:
MIARSSSAVFMESFLMKHLMISTQLSILSHGSESFNSPPKSSVASVLKEMRSL

>ORF99:
MLIEGFNFHFFNGLWMRNESDIILRYVVM

>ORF100:
MTFSHKWTYRCRSNEEKYYLYHLHN

>ORF101:
MIQILHSLDNSVTESYLLLVCLYHSILQTV

>ORF102:
MLQLNVMIQRSFSYACFITPRTCRSKIYSQR

>ORF103:
MDEVTNIRHAINPYIIILILLIITICLIFSLYY

>ORF104:
MLNFSLCLYPVFILNKLVLRTQSIILHTINNASIKNR

>ORF105:
MLYSAMKWCTSFKVTIDIESIQRSNNI

>ORF106:
MVVFVYIIYALLSYTVY AIIMFLPYIPPSYVRLSSIYYFIN

>ORF107:
MNMTESNISMSSLKTDITIVLSLVQNTIVRKNTCVDILH

>ORF108:
MLGIVNAIHVNVVASSSLTGLMFNRDVITRLLSVI

>ORF109:
MPSGNCIVEGIILSRTSNFTILVTLYVLPLYIYSKTHV

>ORF110:
MVIIPGVRCLSLLFLRRRCPLHIISAFTLLAINALILGHTISPVDLSFTICGYEI
RSIFDSETDTIVKFNDIMSQ

>ORF111:
MYNSSIHTPEYDVIIHVIEHLKHHKQCVQTVTSGMVFTSPVSSSICTKSDDGRNL
SDGFLLIRYITTDDFCTIFDIIPRHIFYQLANVDEH

>ORF112:
MEVCHRTILSCNIPTFLNLLVLKLLLQDDCLHTYN

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

```
>ORF113:
MLDVQIDMVVVFSQCYSRWSNFYFDA

>ORF114:
MGFHLPSIHVDDGDPVSIKPLLQLRCITPPIENVDPEINPLDRDGISHFC

>ORF115:
MYEAPITSYPTSQLIVIYSPNEYFSLTG

>ORF116:
MHNTKSFDMLFYIILYQSEVVVTHRESKYFVCIIINSNEQISTLCVGKR

>ORF117:
MNAYAHNSILYHSQYQNDHIQQTTYGV

>ORF118:
MLNFSIYSVSCFKYVMMNPYSFQTQV

>ORF119:
MKILVVPTESVCVKHRHDFGCTHEINNKLSYFLIFIDKNFTSTKHHT

>ORF120:
MVIYCSNSLGAYCKLVINKVAVLLTYFCFVALTNAQFFVSDILVHGKIPPNHLII
QYPSVSRSPRLDTTYPLCESIGVNSRVPLSILFGFLINGTCSPLDMNLETNP

>ORF121:
MVFKISIPINITDLFGNLLLLALITASRSAPNLLITKNRYSTLMDLYRPNALHVI
RPTCFIL

>ORF122:
MIVAVYGNLIMRITYTDRYQLDAMVSRK

>ORF123:
MTRWWRSRYICRSQCSNVKNSTCSQQILYIHLLILSYTTITKSFFKTLNHHQKSM
FKVIRLKYIFEINSCISYPSILDLYIFEINSCISHPSILDLYVLKNTILLIL

>ORF124:
MYFFNYYRKNNKYGIQPYIFLLSLTFYDISTYTSLFCSIDFILSSM

>ORF125:
MSGSYFPNILDPNSPTSGKFIIIQCLFISHDDPLSISSLSRILICGSK

>ORF126:
MSDEINSSQTSLSFPIDMITGITSLGLK

>ORF127:
MSRFFPRFILSYPSKSRKSNGYSICGMGLGRCKLCS

>ORF128:
MFVYKNNFRIQYDRRSFFKCFRYVFFEIIHFMREYWFHVSTKEGKLVIIFMNLYS
FTIVFDFRKHS

>ORF129:
MGNKNIKPSKENRLSILSKDKMDSFKRGSWATSSFKEKSRATIQRFSSLRREHIK
VDHPDKFLELKRGIYEIIQKSSSIDVDKRTKLMSNIKTMMINPFMIEGLMTSLEN
LDPDNKMSYSSVMILGEFDIINISDNEAAFEFINSLLKSLLLLNTRQLKLLEYSI
SNDLLYAHINALEYIIKNTFNVPERQLILRGQYLTPIFSDLLKYAGLTIKSNILM
WNKQFIKPVSDLYTSIRLLYCVTV

>ORF130:
MSIPFMIYHQDMYTQKVNVWPSNWL

>ORF131:
MLHGCTCWLQNISSIRDLRLKEMLTFATITLHRVRTICLIFY

>ORF132:
MSLYLSFISLYHIIESYPIIVIHVDRCRE

>ORF133:
MRHDTFTEHCISLYFKFPDNETIKLGLSEPYLCFKK

>ORF134:
MSSRYNDRRYRGVPSKQLHSIRVLIH
```

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF135:
MPFSHCYLLYMFFNKTSIGINLTLAFYSYYKI

>ORF136:
MQFGSIRCTTNIFPFFSSILRGIFSYKIIWGCLV

>ORF137:
MHLLSFYLLMVYELIYVLQLLIVSL

>ORF138:
MKYILYSRCSFSFSFISNHLTPDGPSKIGWLDKGFIISSSTLYFSMTSNVVCGTT
FPAGKHIPGAGDGNCFVYPSNFDVEKDCLMVFIE

>ORF139:
MINDPHTRNLLIHRNTNAHIYIINSTVQYLFLDRYRIVRLHFFVY

>ORF140:
MFCIYIISTVIISNKIANFRNAEYREYLHLYNVTAAIILNITSIL

>ORF141:
MILFLLIKIIIAMCSSKRIILTKFIVEFCNERI

>ORF142:
MAPSTEHIYDSVAGSTLLINNDRNEQTIYQNTTVVLNEDTKQNPNYSSNPFVNYN
KTSICSKSNPFITELNNKFSENNPFRRAHSDDYLNKQEQDHEHDDIESLV

>ORF143:
MEIFPVFGISKISNFIANNDCRYYIDTEHQKIISDEINRQMDETVLLTNILSVEV
VNDNEMYHLIPHRLSTIILCISSVGGCVISIDNDVNGKNILTFPIDHAVIISPLS
KCVVVSKGPTTILVVKADIPSKRLVTSFTNDILYVNNLSLINYLPLSVFIIRRVT
DYLDRHICDQIFANNKWYSIITIDNKQFPIPSNCIGMSSAKYINSSIEQDTLIHV
CNLEHPFDLVYKKMQSYNSVPIKEQILYGRIDNINMSISISVD

>ORF144:
MQSHRLRNSQTVVLSCFLHQKEEQF

>ORF145:
MAEWHKIIEDISKNNKFEDAAIVDYKTTKNVLAAIPNRTFAKINPGEIIPLITNR
NILKPLIGQKYCIVYTNSLMDENTYAMELLTGYAPVSPIVIARTHTALIFLMGKP
TTSRRDVYRTCRDHATRVRATGN

>ORF146:
MAFDISVNASKTINALVYFSTQQNKLVIRNEVNDTHYTVEFDRDKVVDTFISYNR
HNDTIEIRGVLPEETNIGCAVNTPVSMTYLYNKYSFKLILAEYIRHRNTISGNIY
SALMTLDDLAIKQYGDIDLLFNEKLKVDSDSGLFDFVNFVKDMICCDSRIVVALS
SLVSKHWELTNKKYRCMALAEHISDSIPISELSRLRYNLCKYLRGHTESIEDEFD
YFEDDDSSTCSAVTDRETDV

>ORF147:
MTSLREFRKLCCDIYHASGYKEKSKLIRDFITDRDDKYLIIKLLLPGLDDRIYNM
NDKQIIKLYSIIFKQSQEDMLQDLGYGYIGDTIRTFFKENTEIRPRDKSILTLEE
VDSFLTTLSSVTKESHQIKLLTDVASVCTCNDLKCVVMLIDKDLKIKAGPRYVLN
AISPHAYDVFRKSNNLKEIIENASKQNLDSISISVMTPINPMLAESCDSVNKAFK
KFPSGMFAEVKYDGERVQVHKNNNEFAFFSRNMKPVLSHKVDYLKEYIPKAFKKA
TSIVLDSEIVLVDEHNVPLPFGSLGIHKKKEYKNSNMCLFVFDCLYFDGFDMTDI
PLYERRSFLKDVMVEIPNRIVFSELTNISNESQLTDVLDDALTRKLEGLVLKDIN
GVYEPGKRRWLKIKRDYLNEGSMADSADLVVLGAYYGKGAKGGIMAVFLMGCYDD
ESGKWKTVTKCSGHDDNTLRELQDQLKMIKINKDPKKIPEWLVVNKIYIPDFVVE
DPKQSQIWEISGAEFTSSKSHTANGISIRFPRFTRIREDKTWKESTHLNDLVNLT
KS

>ORF148:
MRGVKFISRSHSSHECFLFYQRKCLVDYSPV

>ORF149:
MDIKNLLTACTIFYITTLATADIPTPPPTGHVTRENILIRGIINVVIGVHLENLP
RLDVMVTITQNVNAAHLIHIPQSPIILMDVINVENAQPDHLIR

>ORF150:
MNKEILFVNRAVLVNIATTYVIIDLIHFLHANYLNVINYDFDDNVTIHYIATWLV
YYSV

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF151:
MNSSSKLIAVINGFRNSGRFCDINIVINDERINAHRLILSGASEYFSILFSNNFI
DSNEYEVNLSHLDYQSVNDLIDYIYGIPLSLTNDNVKYILSTADFLQIGSAITEC
EKYILKNLCSRNCIDFYIYADKYNNKKIESASFNTILRNILRLINDENFKYLTEE
SMIKILSDDMLNIKNEDFAPLILIKWLESTQQSCTVELLRCLRISLLSPQVIKSL
YSHQLVSSIYECITFLNNIAFLDESFPRYHSIELISIGISNSHDKISINCYNHKK
NTWEMISSRRYRCSFAVAVLDNIIYMMGGYDQSPYRSSKVIAYNTCTNSWIYDIP
ELKYPRSNCGGLADDEYIYCIGGIRDQDSSLTSSIDRWKPSKPYWQKYAKMREPK
CDMGVAMLNGLIYVMGGIVKGDTCTDALESLSEDGWMKHQRLPIKMSNMSTIVHD
GKIYISGGYNNSSVVNVISNLVLSYNPIYDEWTKLSSLNIPRINPALWSAHNKLY
VGGGISDDVRTNTSETYDKEKDCWTLDNGHVLPRNYIMYKCEPIKHKYPLEKTQY
TNDFLKYLESFIGS

>ORF152:
MSGIVKSIILSGPSGSGKTAIAKRLWEYIWICGVPYH

>ORF153:
MAMFYAHALGGYDENLHAFPGISSTVANDVRKYSVVSVYNNKYDIVKDKYMWCYS
QVNKRYIGALLPMFECNEYLQIGDPIHDQEGNQISIITYRHKNYYALSGIGYESL
DLCLEGVGIHHHVLETGNAVYGKVQHDYSTIKEKAKEMNALSSGPIIDYHVWIGD
CICQVTAVDVHGKEIMRMRFKKGAVLQIPNLVKVKLGENDTENLSSTISAAPSR

>ORF154:
MDFFKKEILDWSVYLSLHYIARVCSNSSTSHIIQDYNLVRTYEKVDKTIVDFLSR
LPNLFHILEYGENILHIYSMDDANTNIIIFFLDRVLNINKNGSFIHNLRLSSSIN
IKEYVYQLVNNDHPDNRIRLMLENGRRTRHFLSYISDTVNIYICILINHGFYIDA
EDSYGCTLLHRCIYHYKKSESESYNELIKILLNNGSDVDKKDTYGNTPFILLCKH
DINNVELFEICLENANIDSVDFNRYTPLHYVSCRNKYDFVKLLISKGANVNARNK
FGTTPFYCGIIHGISLIKLYLESDTELEIDNEHIVRHLIIFDAVESLDYLLSRGV
IDINYRTIYNETSIYDAVSYNAYNTLVYLLNRNGDFETITTSGCTCISEAVANNN
KIIMEVLLSKRPSLKIMIQSMIAITKNKQHNADLLKMCIKYTACMTDYDTLIDVQ
SLQQYKWYILKCFDEIDIMKRCYIKNKTVFQLVFCIKDINTLMRYGKHPSFVKCT
SLDVYGSRVRNIIASIRYRQRLISLLSKKLDAGDKWSCFPNEIKYKILENFNDNE
LSTYLKIL

>ORF155:
MLISTMPLEHFYSGTIITRDLLCMEEVTPYYIIYTGYLQDAPLYRSMI

>ORF156:
MYKKLITFLFVIGALASYSNNEYTPFNKLSVKLYIDGVDNIENSYTDDNNELVLN
FKEYTISIITESCDVGFDSIDIDVINDYKIIDMYTIDSSTIQRRGHTCRISTKLS
CHYDKYPYIHKYDGDEQQYSITAEGKCYKGIKYEISMINDDTLLRKHTLKIGSTY
IFDRHGHSNTYYSKYDF

>ORF157:
MRYIIILAVLFINSIHAKITSYKFESVNFDSKIEWTGDGLYNISLKNYGIKTWQT
MYTNVPEGTYDISAFPKNDFVSFWVKFEQGDYKVEEYCTGLCVEVKIGPPTVTLT
EYDDHINLYIEHPYATRGSKKIPIYKRGDMCDIYLLYTANFTFGDSKEPVPYDID
DYDCTSTGCSIDFVTTEKVCVTAQGATEGFLEKITPWSSKVCLTPKKSVYTCAIR
SKEDVPNFKDKMARVIKRKFNKQSQSYLTKFLGSTSNDVTTFLSMLNLTKYS

>ORF158:
MDSGIYETPINYKKSNVSAVSVNNTIFVTGGLFINNSNSTIVVNNMEKLDIYKDK
QWSIIEMPMARVYHGIDSTFGMLYFAGGLSVTEQYGNLEKNNEISCYNPRTNKWF
DISYTIYKISISSLCKLNNVFYVFSKDIGYVEKYDGAWKLVHDRLPAIKALSTSP
Y

>ORF159:
MARNGLSEILYILVIQYYIRSEKISLVRSTIT

>ORF160:
MDIFREIASSMKGENVFISPASISSVLTILYYGANGSTAEQLSKYVETEENTDKV
SAQNISFKSMNKVYGRYSAVFKDSFLRKIGDKFQTVDFTDCRTIDAINKCVDIFT
EGKINPLLDEPLSPDTCLLAISAVYFKAKWLMPFEKEFTSDYPFYVSPTEMVDVS
MMSMYGKAFNHASVKESFGNFSIIELPYVGDTSMMVILPDKIDGLESIEQNLTDT
NFKKWCNSLEATFIDVHIPKFKVTGSYNLVDTLVKSGLTEVFGSTGDYSNMCNSD
VSVDAMIHKTYIDVNEEYTEAAAATCALVSDCASTITNEFCVDHPFIYVIRHVDG
KILFVGRYCSPTTNC

>ORF161:
MTANFSTHVFSPQHCGCDRLTSIDDVRQCLTEYIYWSSYAYRNRQCAGQLYSTLL
SFRDDAESVFIDIRELVKNMPWDDVKDCTEIIRCYIPDEQKTIREISAIIGLCAY
AATYWGGEDHPTSNSLNALFVMLEMLNYVDYNIIFRRMN

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF162:
MYRQRAIFCIIHGVRKRASNLTMSSNKYAIIRI

>ORF163:
MTHFTIGTLRIAILKRIDTHFQNTCRLINTMV

>ORF164:
MRDTLMYIIKICTCQRYMINYFLFSQIKIVY

>ORF165:
MEMYPRHRYSKHSVFKGFSDKVRKNDLDMNVVKELLSNGASLTIKDSSNKDPITV
YFRRTIMNLEMIDIINKHTTIDERKYIVHSYLKNYKNFDYPFFRKLVLTNKHCLN
NYYNISDSKYGTPLHILASNKKLITPNYMKLLVYNGNDINARGEDTQMRTPLHKY
LCKFVYHNIEYGIRYYNEKIIDAFIELGADLTIPNNDGMIPVVYCIHSNAEYGYN
NITNIKIIRKLLNLSRRASHNLFRDRVMHDYISNTYIDLECLDIIRSLDGFDING
YFEGRTPLHCAIQHNFTQIAKYLLDRGADIVVPNTLIIHQYIQ

>ORF166:
MIYMLYATSKMKKMLRLVYLDITRIRITDGNWLRRQKADYQLCILFFMTIP

>ORF167:
MNRICYKIHLMCTLANGIICVINIRIVISCTIYYPSTKYNRIK

>ORF168:
MNLQKLSLAIYLTATCSWCYETCIRKTALYHDIQLEHVEDNKDSVASLPYK

>ORF169:
MIEVILFFITSASICPLMRKRHLIRCIVKRNLLKSW

>ORF170:
MKPKVNNIGNTPLHNYVSQYDITLIPHPQPIKKMEIKALY

>ORF171:
MRYIVTSSINAIQTLRLFDCYSLAESRDFVETTKD

>ORF172:
MAVNHVSNNGRLCMYGLILSRFNNCGYHCYETILIDVFDILSKYMDNIDMIDNEN
KTLLYYAVDVNNIQFAKRLLEYGASVTTSRSIINTAIQKSSYRRENKTRIVDLLL
SYHPTLETMIDAFNRDIRYLYPEPLFACIRYALILDDDFPSKVSMISPVVIRN

>ORF173:
MLFYLEEPIRGYVIILIVHPSWNDCATGHILIMLLNWHEQKEEGQHLLYLFIKHN
QGYTLNILRYLLDRFDIQKDEYYNTAFQNCNNNVASYIGYDINLPTKDGIRLGV

>ORF174:
MYDDLKPVPRNTFNYIDVEINLYPVNDTSCTRTTTTGLSESISTSELTITMNHKD
CNPVFRDGYFSVLNKVATSGFFTGERCAL

>ORF175:
MHVPASLQQSSSSCTEEENKHHMGIDVIIKVTKQDQTPTDDKICQSVTEITESES
DPDPEVESVEDVDPPTTYYSIIGGGLRMNFGFTKCPQIKSISESADGKTVRCLST
SDVAKKRKTATSRPIQYSGLTSLIRK

>ORF176:
MSTDRHLKVQPMILHSSIQQNSKRVSESITLFI

>ORF177:
MSRVNRTIQAHHELKKCTGHYIPVCKTKSYLSRLLLFLSQ

>ORF178:
MVSLKYFYSHSLFNGVIKYFYSLSLFDGLTKILNLFLMVSLKYFYSHSLFNGVIK
YFYSLSLFDGLIKKVLQKYFYSLSLFDGLIKKVLQKYFYSLSLFDGLIKKFYKNI
FILFLSLMVSQKYFYSLSLFDGLIKKVLQKYFYSLSLFDGLIKNIKPLSDGVTKI
FLFSFSLQWSHKIFLFSFSLRWSHKNIKPLSDGVTKIFLFSFSLQWSHKIFLFSF
SL

>ORF179:
MTMRCTILFLIDYRRLYSVLVLSEDVLSL

>ORF180:
47818:
MVIQFPSNILCRIIYSTRNNDGIITCCILYGLCSCYNNQRIEVYQRYSNS

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF181:
MCLNDEGGPSSLSSHRWSTFLKVELECDIDGRSYRQIIHSRTIKTDNDTILYVFF
DSPYSKSALCTYSMNTIKQSFSTSKLEGYTKQLPSPAPGICLPAGKVVPHTTFEV
IEKYNVLDDIIKPLSNQPIFEGPSGVKWFDIKEKENEHREYRIYFIKENSIYSFD
TKSKQTRSSQVDARLFSVMVTSKPLFIADIGIGVGMPQMKKILKM

>ORF182:
MPRRMELKNGNIFVVQRILPNCIRVTLYNNYTTFLS

>ORF183:
MLFNVSALIVYFDVCSHIVYAIVRL

>ORF184:
MGHRIYRFRSPWIQTSKLRVYGIAISVYTNCMKIKKTV

>ORF185:
MCIERVEITLPVYAQLVIKIKSNIHM

>ORF186:
MMMMKWIISILTMSIMPVLAYSSSIFRFHSEDVELCYGHLYFDRIYNVVNIKYNP
HIPYRYNFINRTLTVDELDDNVFFTHGYFLKHKYGSLNPSLIVSLSGNLKYNDIQ
CSVNVSCLIKNLATSTSTILTSKHKTYSLHRSTCITIIGYDSIIWYKDINDKYND
IYDFTAICMLIASTLIVTIYVFKKIKMNS

>ORF187:
MHRVIIDCTIHNVTVLLTLLVKDFRQFVSFSVNSSGS

>ORF188:
MLMADEWITVFIGSYCFHATSIDQILDS

>ORF189:
MYNFFYSVKDMIKNIIVVFIPFQSPYMIL

>ORF190:
MIYSNAFMWAYNKSLLMEYSKSFSCLVFNKRRDFNRLFMNSNAASLSLILMMSNS
PNIITDE

>ORF191:
MNGFIIIVFMLDMSLVRLSTSIDDDF

>ORF192:
MVARDFSLKDDVAQDPLLNESILSLDKMDSLFSLDGLIFLLPMIYKGRPNRLG

>ORF193:
MDEAYYSGNLESVLGYVSDMHTELASISQLVIAKIETIDNDILNKDIVNFIMCRS
NLDNPFISFLDTVYTIIDQEIYQTELINSLDDNEIIDCIVNKFMSFYKDNLENIV
DAIITLKYIMNNPDFKTTYAEVLGSRIADIDIKQVIRKNILQLSNDIRERYL

>ORF194:
MDGVIVYCLNALVKHGEEINHIKNDFMIKPCCERVCEKVKNVHIGGQSKNNTVIA
DLPYMDNAVSDVCNSLYKKNVSRISRFANLIKIDDDDKTPTGVYNYFKPKDVIPV
IISIGKDKDVCELLISSDISCACVELNSYHVAILPMNVSFFTKGNASLIILLFDF
SIDAAPLLRSVTDNNVIISRHQRLHDELPSSNWFKFYISIKSDYCSILYMVVDGS
VMHAIADNRTHAIISKNILDNTTINDECRCCYFEPQIRILDRDEMLNGSSCDMNR
HCIMMNLPDVGEFGSSMLGKYEPDMIKIALSVAGNLIRNRDYIPGRRGYSYYVYG
IASR

>ORF195:
MDIKIDISISGDKFTVTTRRENEERKKYLPLQKEKTTDVIKPDYLEYDDLLDRDE
MFTILEEYFMYRGLLGLRIKYGRLFNEIKKFDNDAEEQFGTIEELKQKLRLNSEE
GADNFIDYIKVQKQDIVKLTVYDCISMIGLCACVVDVWRNEKLFSRWKYCLRAIK
LFINDHMLDKIKSILQNRLVYVEMS

>ORF196:
MMFELIHLKHTIKKKIVGHWIMVTCYHAII

>ORF197:
MTRLPILLLLISLVYATPFPQTSKKIGDDATLSCNRNNTNDYVVMSAWYKEPNSI
ILLAAKSDVLYFDNYTKDKISYDSPYDDLVTTITIKSLTARDAGTYVCAFFMTST
TNDTDKVDYEEYSTELIVNTDSESTIDIILSGSTHSPETSSEKPEDIDNFNCSSV
FEIATPEPITDNVEDHTDTVTYTSDSINTVSASSGESTTDETPEPITDKEEDHTV
TDTVSYTTVSTSSGIVTTKSTTDDADLYDTYNDNDTVPPTTVGGSTTSISNYKTK
DFVEIFGITALIILSAVAIFCITYYIYNKRSRKYKTENKV

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF198:
MEREGVDYHYVNREAIWKGIAAGNFLEHTEFLGNIYGTSKTAVNTAAINNRICVM
DLNIDGVRSLKNTYLMPYSVYIRPTSLKMVETKLRCRNTEADDEIHRRVMLAKTD
MDEAGEAGLFDTIIIEDDVNLAYSKLIQILQDRIRMYFNTN

>ORF199:
31420:
MNFQGLVLTDNCKNQWVVGPLIGKGGFGSIYTTNDNNYVVKIEPKANGSLFTEQA
FYTRVLKPSVIEEWKKSHNIKHVGLITCKAFGLYKSINVEYRFLVINRLGADLDA
VIRANNNRLPKRSVMLIGIEILNTIQFMHEQGYSHGDIKASNIVLDQIDKNKLYL
VDYGLVSKFMSNGEHVPFIRNPNKMDNGTLEFTPIDSHKGYVVSRRGDLETLGYC
MIRWLGGILPWTKISETKNCALVSATKQKYVNNTATLLMTSLQYAPRELLQYITM
VNSLTYFEEPNYDEFRHILMQGVYY

>ORF200:
MPFLEYHRLLPMMSGNILLCQFIITSMTL

>ORF201:
MNIYKLEIRSMIKKEIKSLSSHIATKTTML

>ORF202:
MIQKIFLLLYRRHHRGNHLSRRPRE

>ORF203:
MRLPRHTCALSKWKDAVVLCLQIGQNHGIWILMVSRSILQMNGCHI

>ORF204:
MLQNINYIWIFLKRKYLTGVYIYLFII

>ORF205:
MQKTVTVVHYYIDVYITIRNQNQNHTMN

>ORF206:
MKTISVVTLLCVLPAVVYSTCTVPTMNNAKLTSTETSFNDKQKVTFTCDQGYHSL
DPNAVCETDKWKYENPCKKMCTVSDYVSELYDKPLYEVNSTMTLSCNGETKYFRC
EEKNGNTSWNDTVTCPNAECQPLQLEHGSCQPVKEKYSFGEYMTINCDVGYEVIG
ASYISCTANSWNVIPSCQQKCDIPSLSNGLISGSTFSIGGVIHLSCKSGFILTGS
PSSTCIDGKWNPILPTCVRSNEKFDPVDDGPDDETDLSKLSKDVVQYEQEIESLE
ATYHIIIVALTIMGVIFLISVIVLVCSCDKNNDQYKFHKLLP

>ORF207:
MISTLIFTNMMVMSNNILLLQRENAIKE

>ORF208:
MDIVIHIIQNMIFKNLKYIITSVTVVK

>ORF209:
MVYTIYPLKIMASRRGKQCIQMYQKEHTTYPHFQRMISYLSGLNLNKAIIKWKSI
VRDYASK

>ORF210:
MLLEVAKRFLFTNAVTCVISTCCIRLTSHSEILKNQYHMISMTTIARLQVAA

>ORF211:
MIQKRNKTAYYTLVNALIGSNHFQDEVPDYSPSVPLYHLLHVY

>ORF212:
MRHYDKHVRVYTLSRIYPWKNRTEEYTD

>ORF213:
MSMKSIQKQLQQLVHWCQTVHQQLQMSSV

>ORF214:
20587:
MHTATGNALDSCIPHSSLLEMMRNQCSSTFASW

>ORF215:
MMSKIVQKSSVVIYRMSKKPSERFRPSSDFVHMLLLTGEVKTIPLVTV

>ORF216:
MSILPIIFLPIFFYSSFVQTFNAPECIDKGQYFASFMELENEPVILPCPQINTLS
SGYNILDILWEKRGADNDRIIPIDNGSNMLILNPTQSDSGIYICITTNETYCDMM
SLNLTIVSVSESNIDLISYPQIVNERSTGEMVCPNINAFIASNVNADIIWSGHRR
LRNKRLKQRTPGIITIEDVRKNDAGYYTCVLEYIYRGKTYNVTRIVKLEVRDKII

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

PSTMQLPDGIVTSIGSNLTIACRVSLRPPTTDADVFWISNGMYYEEDDGDGDGRI
SVANKIYMTDKRRVITSRLNINPVKEEDATTFTCMAFTIPSISKTVTVSIT

>ORF217:
MRTFTTKHHKNESSSDLCFKYQPQINS

>ORF218:
MSRRNNVTQTVHCSRHYTICSFKMP

>ORF219:
MTMKMMVHIYFVSLLLLLFHSYAIDIENEITEFFNKMRDTLPAKDSKWLNPACMF
GGTMNDIAALGEPFSAKCPPIEDSLLSHRYKDYVVKWERLEKNRRRQVSNKRVKH
GDLWIANYTSKFSNRRYLCTVTTKNGDCVQGIVRSHIKKPPSCIPKTYELGTHDK
YGIDLYCGILYAKHYNNITWYKDNKEINIDDIKYSQTGKKLIIHNPELEDSGRYN
CYVHYDDVRIKNDIVVSRCKILTVIPSQDHRFKLILDPKINVTIGEPANITCTAV
STSLLIDDVLIEWENPSGWLIGFDFDVYSVLTSRGGITEATLYFENVTEEYIGNT
YKCRGHNYYFEKTLTTTVVLE

>ORF220:
MNSESDNISIKTEYEFYDETQDQSTQLVGYDIKLKTNEDDFMAMIDQWVSMII

>ORF221:
MDSISMVTLKDVHHFIALYNITSLRLLSTY

>ORF222:
MLALLMVCNMIDCVRNTNLLSMNTGYKHKLKFNIIYL

>ORF223:
MMIYGLIACLIFVTSSIASPLYIPVIPPITEDKSFNSVEVLVSLFRDDQKDYTVT
SQFNNYTIDTKDWTIGVLSTPDGLDIPLTNITYWSRFTIGRALFKSESEDIFQKK
MSILGVSIECKKSSTLLTFLTVRKMTRVFNKFPDMAYYRGDCLKAVYVTMTYKNT
KTGETDYTYLSNGGLPAYYRNGVDG

>ORF224:
MIHVLKYFPNKSFKYCINYEKLCYASMMQRCLMIRY

>ORF225:
MISLSFLIHNPLKKWKLKPSISINGYRSTFTMASPCAQFRPCHCHATKDSLNTVA
DVRHCLTEYILWVSHRWTHRESAGSLYRLLISFRTDATELFGGELKDSLPWDNID
NCVEIIKCFIRNDSMKTAEELRAIIGLCTQSAIVSGRVFNDKYIDILLMLRKILN
ENDYLTLLDHIRTAKY

>ORF226:
MRIKLYYITRSMSIIYNLQSGYWNMERVLQHHAR

>ORF227:
MTYYKIDSVQDDKNIYRHHKHGVYFICLA

>ORF228:
MDEIVRIVRDSMWYIPNVFMDDGKNEGHVSVNNVCHMYFTFFDVDTSSHLFKLVI
KHCDLNKRGNSPLHCYTMNTRFNPSVLKILLHHGMRNFDSKDEKGHIPLHHYLIH
SLSIDNKIFDILTDTIDDFSKSSDLLLCYLRYKFNGSLNYYVLYKGSDPNCVDED
GLTSLHYYCKHISTFYKSNYYKLSHTKMRAEKRFIYAIIDYGANINAVTHLPSTV
YQT

>ORF229:
MLPHTSDTTSTFRLKTVFDLVFENRNIIYKADVVNDIIHHRLKVSLPMIKSLFYK
MSLPTTITT

>ORF230:
MWKLICIPSTTHRVLGRPLPVSANPSQRRN

>ORF231:
MKQYIVLACMCLPVFSNHPHRVRKKKTNIIWESMLLSKSQSKTKHRPMIRFANP

>ORF232:
MVSLKYFYSLSLFNGVIKYFYSLSLFDGLTKILNLFLMVSLKYFYSLSLFNGVIK
YFYSLSLFDGLTKIFLFSFSL

>ORF233:
MVSLKYFYSHSLFNGVIKYFYSLSLFDGLTKILNLFLMVSLKYFYSHSLFNGVIK
YFYSLSLFDGLIKKVLQKYFYSLSLFDGLIKKVLQKYFYSLSLFDGLIKKVLQKY
FYSLSLFDGLIKKVLQKYFYSLSLFDGLIKKVLQKYFYSLSLFDGLIKNIKPLSD
GVTKIFLFSFSFSLSLFNGVIKYFYSLSLFDGLTKILNLFLMVSLKYFYSHSLFN

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

GVIKYFYSLSLFDGLIKKVLQKYFYSLSLFDGLIKKVLQKYFYSLSLFDGLIKKV
LQKYFYSLSLFDGLIKKVLQKYFYSLSLFDGLTKILNLFLMES

>ORF234:
MDSFSSLFMKLCCISTDKTGSKKSDKKNKNKIKDYYKITIVPGSSSTSTSSWYYT
HA

>ORF235:
MRCTAHDNLHSNQNENTLVIIRNIDGNVIINNPIICRRVNIDG

>ORF236:
MIPLLFILFYFANGIEWHKFETSEEIISTYLLDDVLYTGVNGAVYTFSNNKLNKT
GLTNNNYITTSIKVEDAEPITEIPNVGK

>ORF237:
MVYEEHSSIKMVLMTKFTFFSLILSAQRELSKFRI

>ORF238:
MNKHKTDYAGYACCVICGLIVGIIFTATLLKVVERKLVHTPSIDKTIKDAYIRED
CPTDWISYNNKCIHLSTDRKNLGGRT

>ORF239:
MLPTSEGGTVLKSLGFNLLPLVFMKSFVLSTSHFK

>ORF240:
MSTIHSSVNFTRSSWVIEFIGSVVHGSKLANFAYTVSRLVYTPTV

>ORF241:
MLLEMDKIKITVDSKIGNVVTISYNLEKITIDVTPKKKKEKDVLLAQSVAVEEAK
DVKVEEKNIIDIEDDDDMDVESA

>ORF242:
MITELLAFITSCSAIRLLFAYTCPGDIS

>ORF243:
MAVCIIDHDNIRGVIYFEPVHGKDKVLGSVIGLKSGTYSLIIHRYGDISQGCDSI
GSPEIFIGNIFVNRYGVAYVYLDTDVNIFTIIGKALSISKNDQRLACGVIGISYI
NEKIIHFLTINENGV

>ORF244:
MSRGALIVFEGLDKSGKTTQCMNIMESIPANTIKYLNFPQRSTVTGKMIDDYLTR
KKTYNDHIVNLLFCANRWEFASFIQEQLEQGITLIVDRYAFSGVAYAAAKGASMT
LSKSYESGLPKPDLVIFLESGSKEINRNVGEEIYEDVTFQQKVLQEYKKMIEEGD
IHWQIISSEFEEDVKKELIKNIVIEAIHTVTGPVGQLWM

>ORF245:
MLVQCYKWMKHITLATWNQYSDTCPICIPNSHQYLN

>ORF246:
MVKNKARLFERGFHGRFCRFSSTRCLLW

>ORF247:
MTMTRLLLVYIIILNLKMLFLLSYL

>ORF248:
MSVDAVILNHRLGFLIEMRCSMDHRVI

>ORF249:
MKKEKNIYLSKKKKLLMLSNLIILSTMTC

>ORF250:
MFGEMRNCFLDGNIVYERLNCLLMITCLIR

>ORF251:
MWKCHRKLMRAKIYKVVFHICYFFCNS

>ORF252:
MIILKDGYKEFADCMYYFLHYYIGYGRYTYSATNGSCDKGEYLDKRHNQCCNRCP
PGEFAKVRCNGNDNTKCERCPPHTYTTIPNYSNGCHQCRKCPTGSFDKVKCTGTQ
NSKCSCLPGWYCATDSSQTEDC

>ORF253:
MGIYLDLWCPIPLDFLVLWNEKVSITITLTERPSGRE

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF254:
MKRLETIRHMWSVVYDHFDIVNGKECCYVHTHSSNQNPIPSTVKTNLYMKTMGSC
IQMDSMEALEYLSELKESGGWSPRPEMQEFEYPDGVEDTESIERLVEEFFNRSEL
QAGKLVKFGNSINC

>ORF255:
MINRKLHLHVIRDIILWIQMLSAKQINGNTKIHARKCAQFLIMSLNYMISHYTK

>ORF256:
MTNISSINCYRKYKSVKIINNLITNKYQKIKDL

>ORF257:
MSSSVDVDIYDAVRAFLLRHYYNKRFIVYGRSNAILHNIYRLFTRCAVIPFDDIV
RTMPNESRVKQWVMDTLNGIMMNERDVSVSVGTGILFMEMFFDYNKNSINNQLMY
DIINSVSIILANERYRSAFNDDGIYIRRNMINKLYGYASLTTIGTIAGGVCYYLL
MHLVSLYK

>ORF258:
MRSLIIVLLFPSIIYSMSIRRCEKTEEETWGLKIGLCIIAKDFYPERTDCSVHLP
TASEGLITEGNGFRDIRNTDKL

>ORF259:
MDTDVTNVEDIINEIDREKEEILKNVEIENNKNINKNHPSGYIREALVINTSSNS
DSIDKEVIECISHDVGI

>ORF260:
MESFKYCFDNDGKKWIIGNTLYSGNSILYKVRKNFTSSFYNYVMKIDHKSHKPLL
SEIRFYISVLDPLTIDNWTRERGIKYLAIPDLYGIGETDDYMFFVIKNSGRVFAP
KDTESVFEACVTMINTLEFIHSRGFTHGKIEPRNILIRNKRLSLIDYSRTNKLYK
SGNSHIDYNEDMITSGNINYMCVDNHLGATVSKRGDLEMLGYCMIEWFGGKLPWK
NESSIKVIKQKKEYKKFIATFFEDCFPEGNEPLELVRYIELVYTLDYSQTPNYDR
LRKLFIQD

>ORF261:
MGISMSSLVYCEQQEQISIGKGGMRYIDLCSFKTHANFEEFI

>ORF262:
MNSSRYCSLSYSYTCINFLDILQSVLF

>ORF263:
MSRRLIYVLNINRKSTHKIQENEIYTYFSHCNIDHTSTELDFVVKNYDLNRRQHV
TGYTALHCYLYNNYFTNDVLKILLNHDVNVTMKTSSGRMPVYILLTRCCNISHDV
VIDMIDKDKNHLLHRDYSNLLLEYIKSRYMLLKEEDIDENIVSTLLDKGIDPNFK
QDGYTALHYYYLCLAHVYKPGECRKPITIKKAKRIISLFIQHGANLNALDNCGNT
PPFHLYLSIEMCNNIHMTKMLLTFNPNFKICNNHGLTPILCYITSDYIQHDILVML
IHHYETNVGEMPIDERRMIVFEFIKTYSTRPADSITYLMNRFKNINIYTRYEGKT
LLHVACEYNNTHVIDYLIRINGDINALTDNNKHATQLIIDNKENSPYTIDCLLYI
LRYIVDKNVIRSLVDQLPSLPIFDIKSFEKFISYCILLDDTFYDRHVKNRDSKTY
RYAFSKYMSFDKYDGIITKCHDETMLLKLSTVLDTTLYAVLRCHNSKKLRRYLNE
LKKYNNDKSFKIYSNIMNERYLNVYYKDMYVSKVYDKLFPVFTDKNCLLTLLPSE
IIYEILYMLTINDLYNISYPPTKV

>ORF264:
MSTFIIIDQSTENTSIDTTVTINIIYLAIMKIIMNIIMMIMIELV

>ORF265:
MEEDTNISNKVIRYNTVNNIWKTLPNFWTGTINPGVVSHKDDIYVVCDIKDEKNV
KTCIFRYNTNTYNGWELVTTTESRLSALHTILHDNTIMMLHCYESYMLQDTFNVY
TREWNHMCHQHSNSYIMYNILPIY

>ORF266:
MDIFKELILKHPDENVLISPVSILSTLSILNHGAAGSTAEQLSKYIENMNENTPD
DKKDDNNDMDVDIPYCATLATANKIYGSDSIEFHASFLQKIKDDFQTVNFNNANQ
TKELINEWVKTMTNGKINSLLTSPLSINTRMTVVSAVHFKAMWKYPFSKHLTYTD
KFYISKNIVTSVDMMVGTENNLQYVHINELFGGFSIIDIPYEGNSSMVIILPDDI
EGIYNIEKNITDEKFKKWCGMLSTKSIDLYMPKFKVEMTEPYNLVPILENLGLTN
IFGYYADFSKMCNETITVEKFLHTTFIDVNEEYTEASAVTGVFMTNFSMVYRTKV
YINHPFMYMIKDNTGRILFIGKYCYPQ

>ORF267:
MSLESFIITTFNNNSSTNIDNMCHLYVKVCPSSLLFRLFVECCDINKLVEGTTPL
HCYLMNEGFESSVLKNLLKEYVMNTFNVHDIHYTNI

TABLE 4-continued

OV19t Open Read Frames (ORFs) and Corresponding Sequences
(the nucleotide sequences for the identified coding
regions of OV19t, ORF1-ORF275, respectively;
the amino acid sequences below coincide with
SEQ ID NOs: 654-928, respectively)

>ORF268:
MSTYEKTSFNKMHREKKFIKELVKYETESK

>ORF269:
MIAFIIFREIGIISTRIAMDCTCILCRLLDEDVTYKKIKLEIETCHNLSKHIDRR
GNNALHCYVFNKCDTDIKIVRLLLSRGVERLCRNNEGLTPLGAYSKHRYVKSQIV
HLLISSYSNSSNELKSNINDFDLYSYMSSDNIDLRLLKYLIVDKRIRPSKNTNYA
INGLGLVDIYVTTPNPRPEVLLWLLKSECYSTGYVFRTCMYDSDMCKNSLHYYIS
SHRESQSLSKDVIKCLINNNVSIHGRDEGGSLPIQYYWSCSTIDIEIVKLLIKDV
DTCRVYDVSPILEADYLNKRFRVTPYNVDMEIVNLLIERRHTLVDVMRSITSYDS
RDYNHYIIDNILKRFRQQDESIVQAMLINYLHYGDMVVRCMLDNGQQLSSARLLC

>ORF270:
MKNAYISGVSMFDILFKRSKRHRLRYAKNPTSNGTKKN

>ORF271:
MRWTRLYASFATVCGTYLTYLWTTVRMKVTFLSTMFVICILRSLMWIHRLICLS

>ORF272:
MEQTLTRLHTYLQQYTKHSPRVVYALLSRGADTRIRNNLDCTPIMERLCNRSYSH
NVTQLARTKGRRTTSTLSIHKT

>ORF273:
MPHSETVTLASTSIYYIVIPILKTTKLIOSLIMWVM

>ORF274:
MCKESSELEVKYVDGSASEGATDDTSLIDSTKLKACV

>ORF275:
MVSQKYFYSLSLFDGLIKKVLQKYFYSLSLFDGLIKKVLQKYFYSLSLFDGLIKK
VLQKYFYSLSLFDGLIKKVLQKYFYSLSLFDGLIKKVLQKYFYSLSLFDGLIKNI
KPLSDGVTKIFLFSFSLQWSHKIFLFSFSLRWSHKNIKPLSDGVTKIFLFSFSLQ
WSHKIFLFSFSL

TABLE 5

OV19t Open Read Frames (ORFs) and
nr NCBI Database Entry from Blast

| OV19t | Subject.accession |
|---|---|
| ORF1 | P20549.1 |
| ORF17 | ABZ80166.1 |
| ORF26 | DAA80683.1 |
| ORF27 | P20543.1 |
| ORF28 | UJQ44755.1 |
| ORF32 | QGQ59895.1 |
| ORF34 | ABZ80145.1 |
| ORF36 | P68628.1 |
| ORF41 | JQ1823 |
| ORF52 | ABZ80122.1 |
| ORF53 | P20524.1 |
| ORF55 | P20523.1 |
| ORF63 | AAW23389.1 |
| ORF65 | AUL80383.1 |
| ORF66 | AND73835.1 |
| ORF76 | AAQ93296.1 |
| ORF77 | DAA80696.1 |
| ORF79 | AAS49884.1 |
| ORF81 | H36855 |
| ORF82 | P68474.1 |
| ORF87 | P20530.1 |
| ORF90 | ABZ80136.1 |
| ORF91 | AGB75887.1 |
| ORF92 | AAB96478.1 |
| ORF93 | ABD52653.1 |
| ORF104 | YP_910501.1 |
| ORF108 | AAG37700.1 |
| ORF110 | AAW23645.1 |
| ORF111 | P68476.1 |

TABLE 5-continued

OV19t Open Read Frames (ORFs) and
nr NCBI Database Entry from Blast

| OV19t | Subject.accession |
|---|---|
| ORF116 | ABZ80159.1 |
| ORF118 | AAW23628.1 |
| ORF120 | P68472.1 |
| ORF123 | ALF05177.1 |
| ORF128 | P20527.1 |
| ORF129 | AGB75890.1 |
| ORF130 | WVM33661.1 |
| ORF138 | AAW23599.1 |
| ORF140 | CRL86663.1 |
| ORF142 | AAB96531.1 |
| ORF143 | AGK06629.1 |
| ORF145 | AAX78481.1 |
| ORF146 | AAS49868.1 |
| ORF147 | AGB75893.1 |
| ORF149 | AAW23902.1 |
| ORF150 | AHB35818.1 |
| ORF151 | AGB75897.1 |
| ORF152 | AGB75899.1 |
| ORF153 | AGB75902.1 |
| ORF154 | AGB75904.1 |
| ORF155 | ABG56123.1 |
| ORF156 | AAS49882.1 |
| ORF157 | AAX78486.1 |
| ORF158 | YP_233074.1 |
| ORF160 | AGB75913.1 |
| ORF161 | ADZ29313.1 |
| ORF165 | AGB75921.1 |
| ORF168 | AAQ93098.1 |
| ORF169 | DAD53330.1 |

TABLE 5-continued

| OV19t Open Read Frames (ORFs) and nr NCBI Database Entry from Blast | |
|---|---|
| OV19t | Subject.accession |
| ORF170 | ALF04987.1 |
| ORF172 | AIX98921.1 |
| ORF173 | AAX78507.1 |
| ORF174 | AND73828.1 |
| ORF175 | AAT10397.1 |
| ORF176 | WLW36592.1 |
| ORF177 | ALF04974.1 |
| ORF178 | UXO30862.1 |
| ORF181 | AAT10549.1 |
| ORF182 | AIX98861.1 |
| ORF186 | P21065.1 |
| ORF192 | SNB48636.1 |
| ORF193 | AGB75892.1 |
| ORF194 | AGB75894.1 |
| ORF195 | YP_233060.1 |
| ORF197 | P08714.1 |
| ORF198 | AGB75900.1 |
| ORF199 | AAX78484.1 |
| ORF203 | ABD52684.1 |
| ORF206 | ACA50704.1 |
| ORF211 | UZL86921.1 |
| ORF212 | YP_717506.1 |
| ORF216 | AGB75915.1 |
| ORF219 | AAR91035.1 |
| ORF220: | YP_233084.1 |
| ORF222 | AUO38306.1 |
| ORF223 | AAR17846.1 |
| ORF224 | DAD53328.1 |
| ORF225 | AIX98923.1 |
| ORF226 | ABZ79903.1 |
| ORF227 | AGY98963.1 |
| ORF228 | AGB75726.1 |
| ORF229 | YP_232888.1 |
| ORF231 | AXN56046.1 |
| ORF232 | QEM25152.1 |
| ORF233 | UXO30862.1 |
| ORF234 | QMT29602.1 |
| ORF236 | AAT10548.1 |
| ORF238 | AND73998.1 |
| ORF240 | AAG37656.1 |
| ORF241 | YP_233051.1 |
| ORF243 | YP_010509376.1 |
| ORF244 | YP_010509379.1 |
| ORF252 | AGB75896.1 |
| ORF253 | ALF05182.1 |
| ORF254 | P21000.1 |
| ORF257 | AAX78498.1 |
| ORF258 | P21005.1 |
| ORF259 | ABD52693.1 |
| ORF260 | AAR18037.1 |
| ORF261 | QGQ59915.1 |
| ORF263 | AGB75917.1 |
| ORF264 | YP_233083.1 |
| ORF265 | AGB75922.1 |
| ORF266 | AGB75728.1 |
| ORF267 | P21099.1 |
| ORF268 | QMT29643.1 |
| ORF269 | AIX98922.1 |
| ORF270 | UIC71746.1 |
| ORF271 | AUO38295.1 |
| ORF272 | AUO38293.1 |
| ORF274 | AUO38287.1 |
| ORF275 | UXO30862.1 |

EXAMPLES

The invention is further described in the following examples, which do not limit the scope of the invention described in the claims.

Materials and Methods

Study Design

In this study, we evaluated a combination approach using a novel oncolytic virus to induce de novo cell surface expression of tumor antigen targets on solid tumors, which in combination with off-the-shelf bispecific T cell engagers (TCE), redirects endogenous T cell-mediated anti-tumor immunity. Our oncolytic vaccinia virus, CF33 carrying a truncated CD19 (CD19t) was previously developed in combination with CD19-CAR T cells (13).

All in vitro assays were performed with at least duplicate samples and were repeated in at least three independent experiments. In vivo studies were performed using 6- to 8-week-old NSG, using at least three mice per group for all studies, and four to nine mice were included within each group for all therapeutic and survival studies to ensure statistical power and evenly distributed tumor sizes across groups at treatment initiation. The health condition of mice was monitored daily by the Department of Comparative Medicine at City of Hope with euthanasia applied according to the American Veterinary Medical Association Guidelines. Investigators were not blinded when monitoring mouse survival. All studies were performed under approved protocols of the Institutional Animal Care and Use Committee and the institutional review board.

Cell Lines and Viruses

Human triple-negative breast cancer cell line MDA-MB-468 [American Type Culture Collection (ATCC); HTB-132] was cultured in Dulbecco's modified Eagle's medium (DMEM) containing 10% fetal bovine serum (FBS; HyClone) and 1× antibiotic/antimycotic (AA; Gibco), supplemented with 25 mM Hepes (Irvine Scientific) and 2 mM L-glutamine (Thermo Fisher Scientific; complete DMEM). Both MDA-MB-468-CD19t and MDA-MB-468-HER2 cell lines were cultured as mentioned above. Human pancreatic cancer cell line Capan-1 (ATCC, HTB-79) was cultured in Iscove's modified Dulbecco's medium containing 20% FBS and 1× AA. Human pancreatic cancer cell line Panc-1 (ATCC, CRL-1469) was cultured in RPMI containing 10% FBS and 1× AA. Human ovarian cancer cell line OV90 (ATCC CRL-11732) was cultured in 1:1 volume of MCDB 105 medium (Sigma-Aldrich) and medium 199 (Gibco) containing 20% FBS and 1× AA. Human head and neck carcinoma line UM-SCC-47 (EMID Millipore) was cultured in DMEM containing 10% FBS, 1× AA, and 1× non-essential amino acids (NEAA). Human prostate cancer cell line DU145 (ATCC, HTB-81) was cultured in RPMI containing 10% FBS and 1× AA. Human glioblastoma cell line U251T (gift from W. Debinski, Wake Forest School of Medicine) was cultured in complete DMEM. Human embryonic kidney cell line 293T (ATCC CRL-3216) and human fibrosarcoma cell line HT1080 (ATCC CCL-121) were cultured in complete DMEM. African green monkey kidney fibroblasts (CV-1; ATCC CCL-70) were cultured in DMEM containing 10% FBS and 1× AA. CV-1 cells were used for both amplification and titration of orthopoxviruses Generation of Recombinant Chimeric Orthopoxvirus Expressing Human CD19t To generate a shuttle vector containing the human (hCD19t) CD19t expression cassette with the VACV PSE, the hCD19t complementary DNAs (cDNAs) were polymerase chain reaction (PCR) amplified from the plasmids hCD19t-2A-IL2-pHIV7 and mCD19t-epHIV7 using Q5 High-Fidelity 2× Master Mix (New England Biolabs Inc., Ipswich, MA) and the following primers: 5'-GCG GTC GAC CAC CAT GCC ACC TCC TCG CCT CCT CTT CTT CCT CCT CTT CCTC-3' (SEQ ID NO 929) and 5'-GCG GGA TCC ATA AAA ATT AAT TAA TCA TCT TTT CCT CCT CAG GAC CAG GGC TCT TTG AAG ATG-3' (SEQ ID NO: 930). The PCR fragment was digested with Sal I and Bam HI and cloned into the same-cut p33NCTK-SE-hNIS replacing hNIS to yield p33NCTK-SE-hCD19t and p33NCTK-SE-mCD19t. The hCD19t and mCD19t cDNAs in p33NCTK-SE-hCD19t and p33NCTK-SE-mCD19t were confirmed by sequencing. CV-1 cells were infected with CF33 at an MOI of 0.1 for 1 hour and then transfected with p33NCTK-SE-hCD19t and p33NCTK-SE-mCD19t by using jetPRIME in vitro DNA and small interfering RNA transfection reagent (Polyplus-transfection Inc., New York, NY). Two days after infection, infected and transfected cells were harvested, and recombinant viruses (OV19t) were selected and plaque purified as described previously (13).

DNA Constructs

MDA-MB-468 cells were engineered to express hCD19t by transduction with epHIV7 lentivirus carrying the human CD19t gene under the control of the EF1 promoter. This same process was used to engineer the expression of HER2 in MDA-MB-468. The human CD19-28z CAR lentiviral construct with hEGFRt separated by a T2A ribosome skip sequence was used as previously described (21). The human HER2-41BBz CAR lentiviral construct previously described (22) was modified to remove the CD19t domain. For T cell trafficking studies, the firefly luciferase (ffluc) gene was cloned into an epHIV7 lentivirus construct and then used to transduce human T cells cultured as previously described (23).

Human T Cell Enrichment, Lentivirus Production and Transduction, and Ex Vivo Expansion T cell isolation, lentivirus production and transduction, and ex vivo expansion of untransduced (mock) and CAR T cells were performed as previously described (23). Untransduced human T cells in all studies were processed in parallel with CAR T cells.

Extracellular Staining and Flow Cytometry

Flow cytometric analysis was performed as previously described [13, 23]. Tumor cells and T cells were discriminated using CD45 (PerCP, BD Biosciences) for all in vitro studies. T cell activation was determined by using antibodies against CD69 and 4-1BB (CD137) (BD Biosciences). HER2 expression on tumor cells was determined using a HER2 antibody (PE, BD Biosciences). Tumor cells were identified using an antibody recognizing Ep-CAM (APC, BioLegend) for all in vivo studies. CD19t expression following virus infection were determined using an antibody against CD19 (PE-Cy7, BD Pharmingen) for all in vitro and in vivo studies, respectively. For the detection of TCE on the surface of T cells, biotinylated Protein-L (brand) and a secondary streptavidin PE (BD Biosciences) antibody were used. Samples were then washed twice, stained with DAPI for viability, and processed on the MACSQuant Analyzer 10 or 16 (Miltenyi Biotec). Data were analyzed with FlowJo software (v10, TreeStar).

OV Transduction and T Cell Functional Assays

For OV19t transduction and tumor killing assays, tumor targets plated with varying multiplicity of infections (MOIs) of OV19t were co-cultured with untransduced T cells or PBMCs at varying effector T cell-to-tumor cell ratios along with TCE concentrations of either 0, 20, 100, or 500 ng/mL. Cocultures were maintained in complete X-VIVO (Lonza) and in the absence of exogenous cytokines in round-bottom 96-well tissue culture-treated plates (Corning) for 1 to 3 days and analyzed by using flow cytometry as described above. Tumor cell killing by T cells with TCE was calculated by comparing CD45-cell counts relative to the killing observed by T cells without TCE from the same healthy donor in the absence of OV. For T cell activation assays, T cells and tumor targets were cocultured at an effector T cell-to-tumor cell ratio of 1:1 along with varying MOIs of OV in complete X-VIVO in the absence of exogenous cytokines in 96-well plates for 1 to 3 days and analyzed by using flow cytometry for specific markers of T cell activation.

For the preloading of TCE onto T cells, T cells and PBMCs were thawed and rested overnight in X-VIVO containing 10% FBS and IL-2 (100 U/mL) and IL-15 (0.5 ng/mL) cytokines. T cells and PBMCs ($3\times10^6$ cells/mL) were then incubated on ice for 30 minutes with 10 ug/mL, 25 ug/mL, 50 ug/mL or 100 ug/mL TCE. Following incubation, T cells were then washed with PBS and co-cultured with tumor cells targets with varying MOIs of OV. T cell activation and killing was determined as previously mentioned.

For OV transduction of MDA-MB-468-HER2 tumor killing assays, tumor targets plated with varying MOIs of OV19t were co-cultured with untransduced T cells or HER2-CAR T cells at an effector to tumor target ratio of 1:5 (5,000 to 20,000) and maintained in X-VIVO containing 10% FBS. Wells were seeded with either 100% MDA-MB-468, 100% MDA-MB-468-HER2, or 80% MDA-MB-468 and 20% MDA-MD-468-HER2 (80/20). TCE was added at a concentration of 100 ng/mL when indicated. Following 24 hours, wells were rechallenged with 3× the number of MDA-MB-468P tumor cells per well (60,000 cells). Cocultures were maintained for 1-2 days as described above and then analyzed using flow cytometry. For wells rechallenged a second time, an additional round of 3×MDA-MB-468 (60,000 cells) were added to all wells. 72 hours after the second rechallenge, cocultures were processed and analyzed using flow cytometry as mentioned above.

Cytokine Enzyme-Linked Immunosorbent Assay

Tumor cells and T cells were plated into 96-well round-bottom plates (Costar) along with varying MOIs of OV19t in the presence or absence of TCE (CD19-targeting), respectively. After incubations at 37° C. for 24, 48, or 72 hours, supernatants were collected and analyzed according to the human IFN- or IL-2 enzyme-linked immunosorbent assay (ELISA) Ready-SET-Go! (eBioscience) manufacturer's protocol. Plates were read at 450 nm and 570 nm using the Cytation 3 Cell Imaging Multi-Mode Reader and Gen5 Microplate Reader and Imager Software (BioTek).

In Vivo Studies

All animal experiments were performed under protocols approved by the City of Hope Institutional Animal Care and Use Committee. For human tumor xenograft studies, MDA-MB-468 and MDA-MB-468-CD19t cells ($5\times10^6$ cells per mouse) were prepared in PBS and injected subcutaneously into the flank of female NSG mice. Tumor growth was monitored 2-3 times per week by caliper measurement. Once tumor volumes reached about 100 to 300 mm$^3$, OV19t virus was prepared and diluted in PBS (pH 7.4) and intratumorally administered at $10^6$ pfu per MDA-MB-468 tumor-bearing mice. 2 days post OV19t treatment, PBMCs were isolated from leukapheresis products obtained from a consented research participant (healthy donor) under protocols approved by the City of Hope (COH) Internal Review Board (IRB using density gradient centrifugation over Ficoll-Paque (GE Healthcare) followed by multiple washes in PBS/EDTA (Milteny Biotec). PBMCs were then counted, washed, and prepared in PBS (pH 7.4) for intravenous tail vein injection ($5\times10^6$ cells per mouse). Four days post T cell engraftment, mice were treated with TCE (8 ug/ms in PBS) intravenously for five consecutive days (Monday-Friday) and then again for three consecutive days the following week (Monday-Wednesday) for a total of 8 treatments (64 ug total per mouse). Mice were euthanized two weeks post OV19t treatment in accordance with our animal safety guidelines.

For in vivo studies with mice bearing MDA-MB-468-CD19t tumors as CD19t+ controls, treatment with PBMCs and TCE coincided with the same schedule as mentioned above, without OV treatment.

For in vivo T cell trafficking studies, mice were engrafted subcutaneously with either MDA-MB-468 or MDA-MB-468-CD19t and treated with OV19t. Two days post OV19t treatment, firefly luciferase (ffluc)-expressing T cells were thawed, washed, and prepared in PBS (pH 7.4) for intravenous tail vein injection ($5 \times 10^6$ cells per mouse). TCE treatment followed as previously described. ffluc-T cell trafficking was monitored 2-3 times a week by noninvasive optical imaging (LagoX). Mice were imaged after intraperitoneal injection of 150 to 250 uL of d-luciferin potassium salt (PerkinElmer) suspended in PBS (pH 7.4, 4.29 mg per mouse). Flux was then analyzed with Living Image software (Aura).

Statistical Analysis

Data are presented as means±SEM, unless otherwise stated. Statistical comparisons between groups were performed using the unpaired two-tailed Student's t test to calculate P value, unless otherwise stated. Statistical comparison of Kaplan-Meier survival data was performed using the log-rank (Mantel-Cox) test.

Example 1: CD19-CD3 Bispecific T Cell Engagers Redirect Human T Cells to Target Solid Tumors Infected with OV Carrying CD19t (0V19t)

Figure 1B:
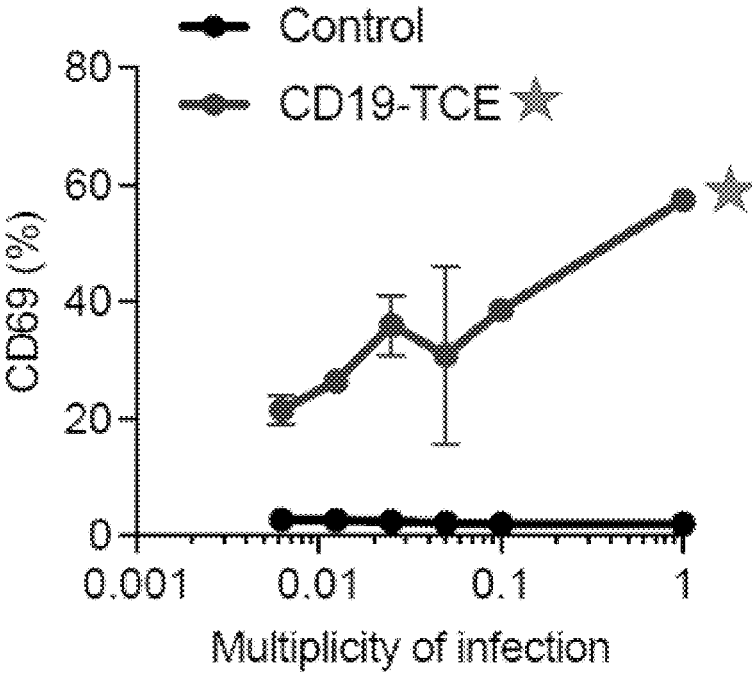
Figure 1C:
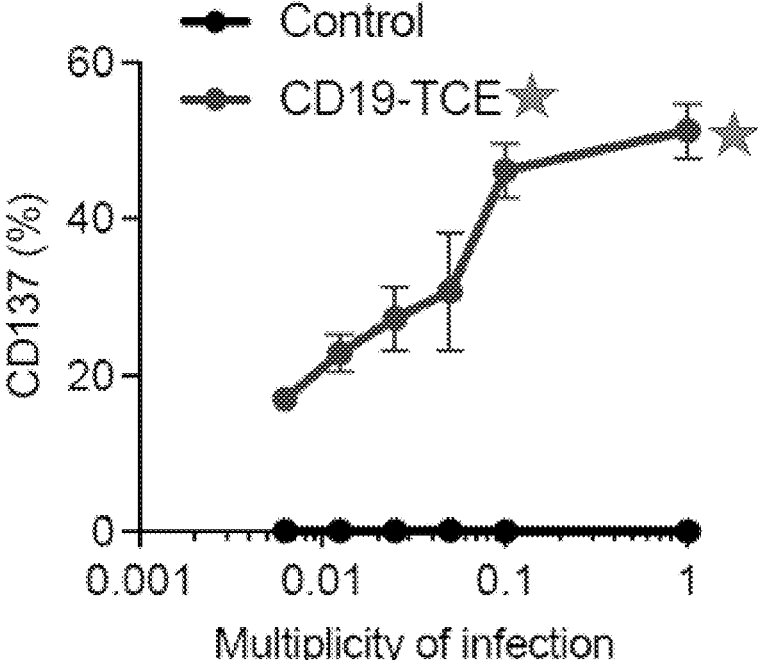
Figure 1D:
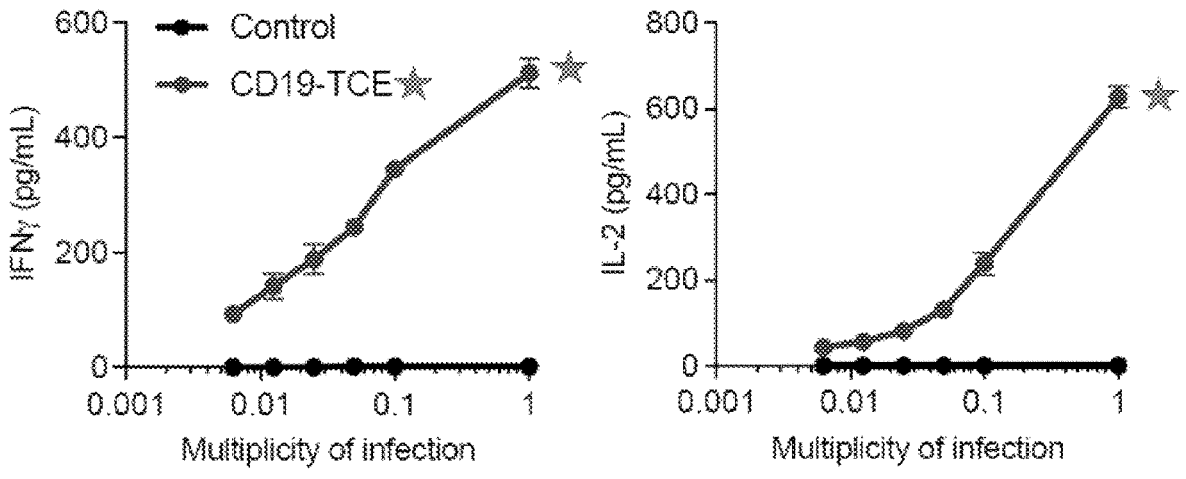

For these studies, we used the oncolytic chimeric orthopoxvirus carrying CD19t (OV19t) as previously described[13]. We first assessed whether the CD19t delivered to tumors via OV could activate non-targeting T cells in the presence of blinatumomab [CD19-CD3 T cell engagers (CD19-TCE)](FIG. 1A). MDA-MB-468 human triple-negative breast cancer tumor cells were infected with varying multiplicity of infection (MOI: 0, 0.00625, 0.0125, 0.025, 0.05, 0.1, and 1) of OV19t and CD19-TCE (100 ng/mL). Tumor cells were then co-cultured with human peripheral blood mononuclear cell (PBMC)-derived non-targeting T cells at an effector-to-target (E:T) ratio of 1:1. At 48 h, T cell activation (CD69, CD137) was induced in the presence of 100 ng/mL CD19-TCE when co-cultured with OV19t-infected tumor cells in an MOI-dependent manner (FIGS. 1B-1C). IFNγ and IL-2 cytokines were produced in an MOI dependent manner (FIG. 1D).

Figure 1E:
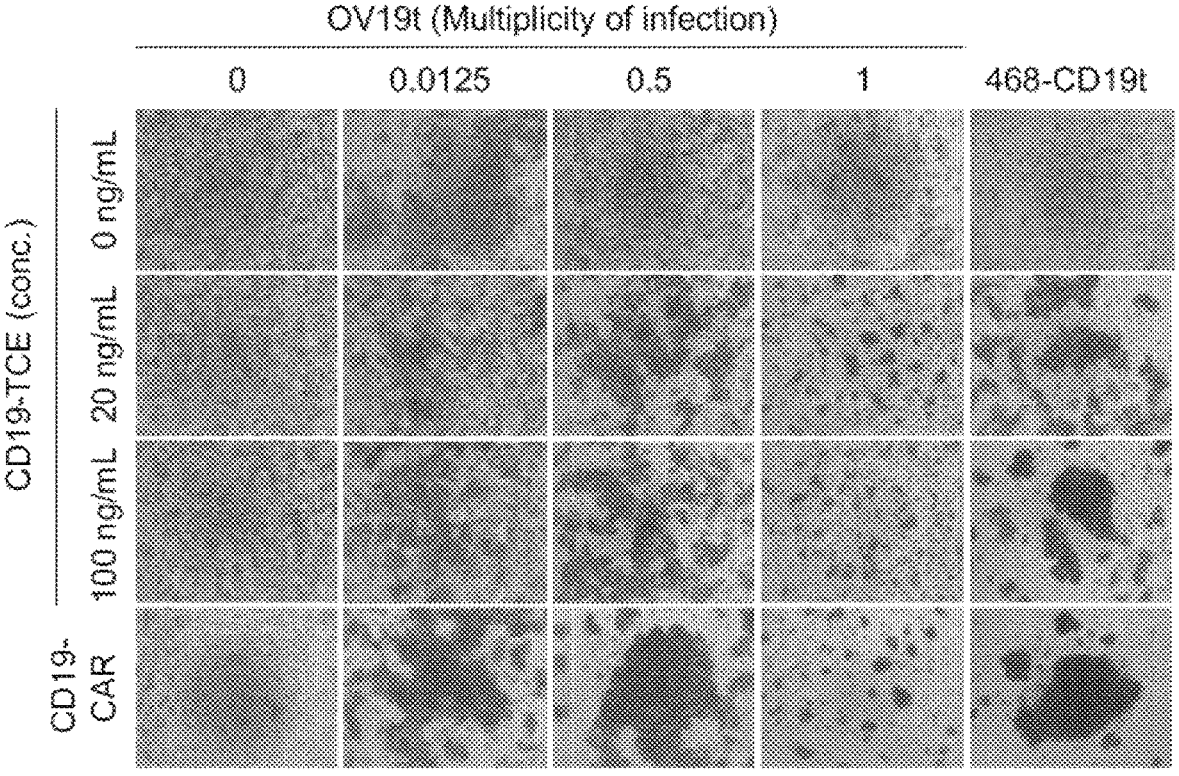
Figure 1F:
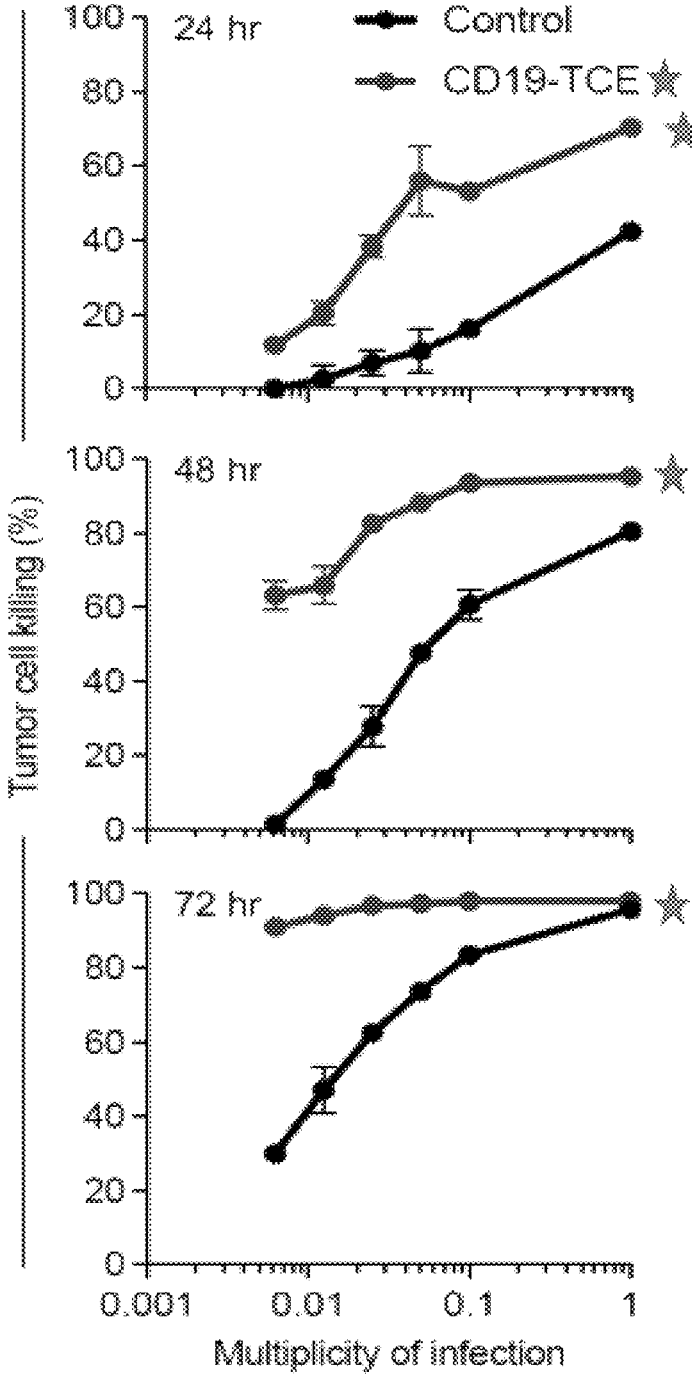
Figure 5A:
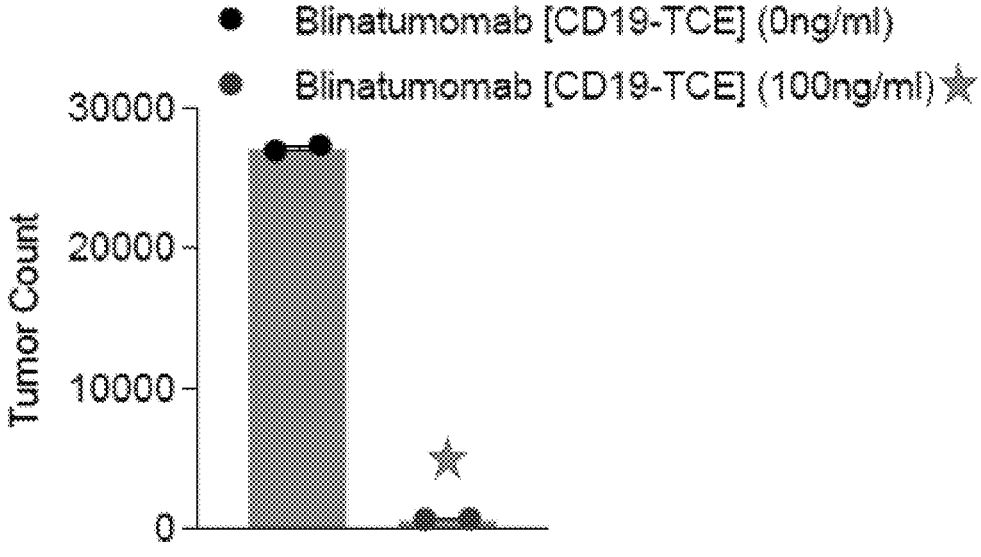
FIGS. 5A-5B. CD19-TCE redirected human T cell cytotoxicity against positive control cell line and OV90 tumor cell killing visualized by phase-contrast microscopy.

We then performed in vitro cell killing assays with tumor cells infected with OV19t at MOIs of 0, 0.0125, 0.5, and 1 in combination with 0, 20, or 100 ng/mL CD19-TCE. MDA-MB-468 tumor cells stably expressing CD19t via lentiviral transduction (MDA-MB-468-CD19t) were used as a positive control. We observed robust tumor cell killing of MDA-MB-468 tumor cells infected with OV19t and co-cultured with non-targeting T cells in the presence of either 20 or 100 ng/mL CD19-TCE when compared to OV19t-infected tumors alone (FIG. 1E). Tumor cell killing was quantified using flow cytometry. At each time point (24h, 48h, and 72h), the presence of non-targeting T cells in combination with CD19-TCE showed greater killing of tumor cells infected with OV19t compared to tumor cells infected with OV19t co-cultured with non-targeting T cells in the absence of CD19-TCE (FIG. 1F). T cell-mediated tumor cell killing when co-cultured with CD19-TCE was confirmed against MDA-MB-468-CD19t cell lines (FIG. 5A).

Figure 1G:
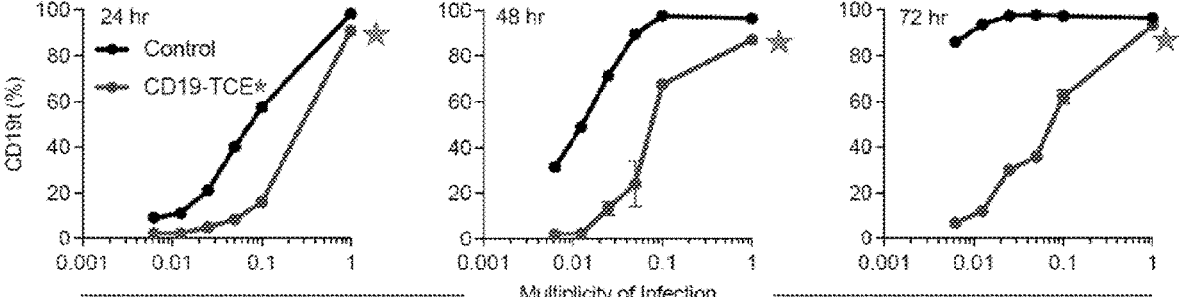
Figures 2A, 2B, 2C:
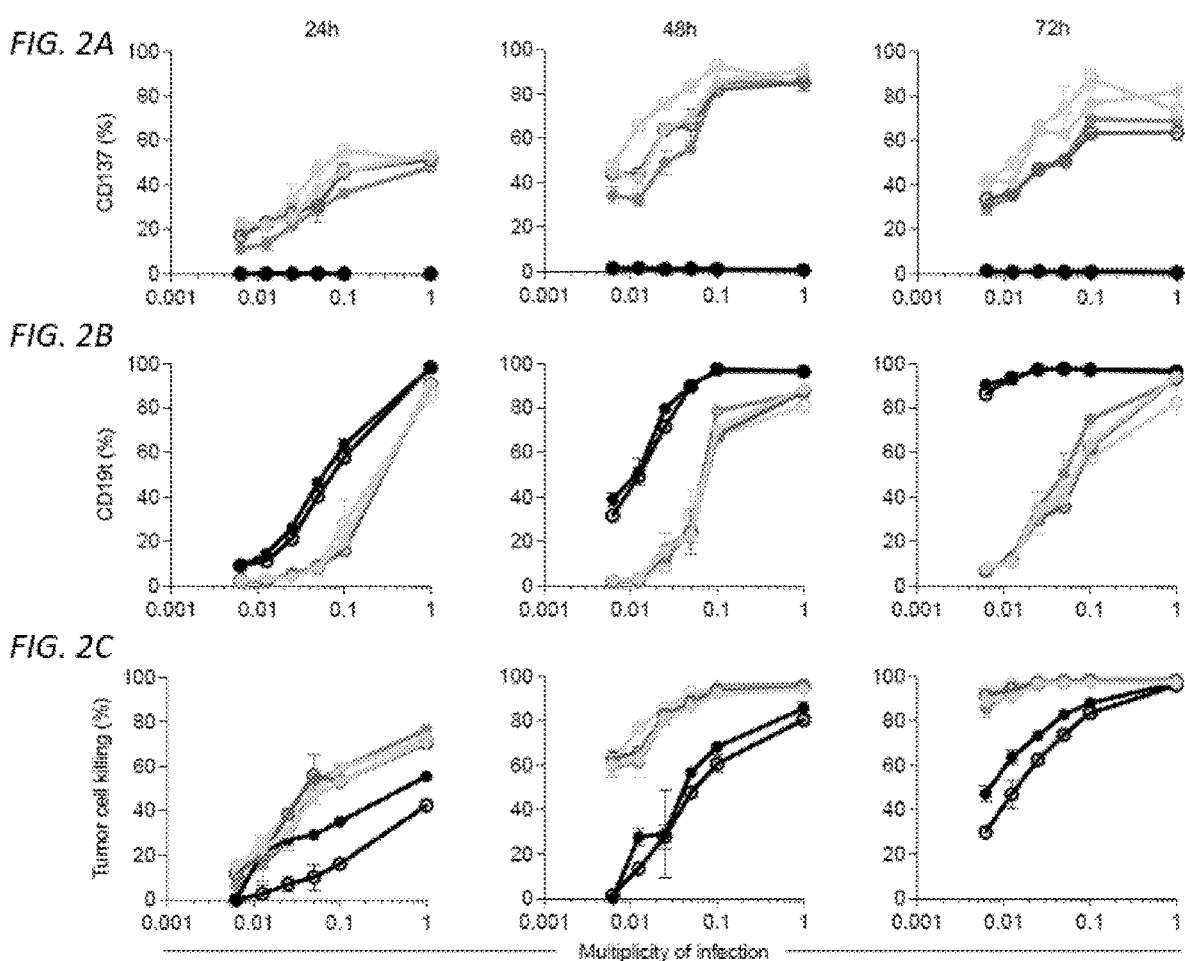
FIGS. 2A-2C. Comparing efficacy of FDA-approved BLINCYTO® to research grade CD19-TCE.
Figure 5B:
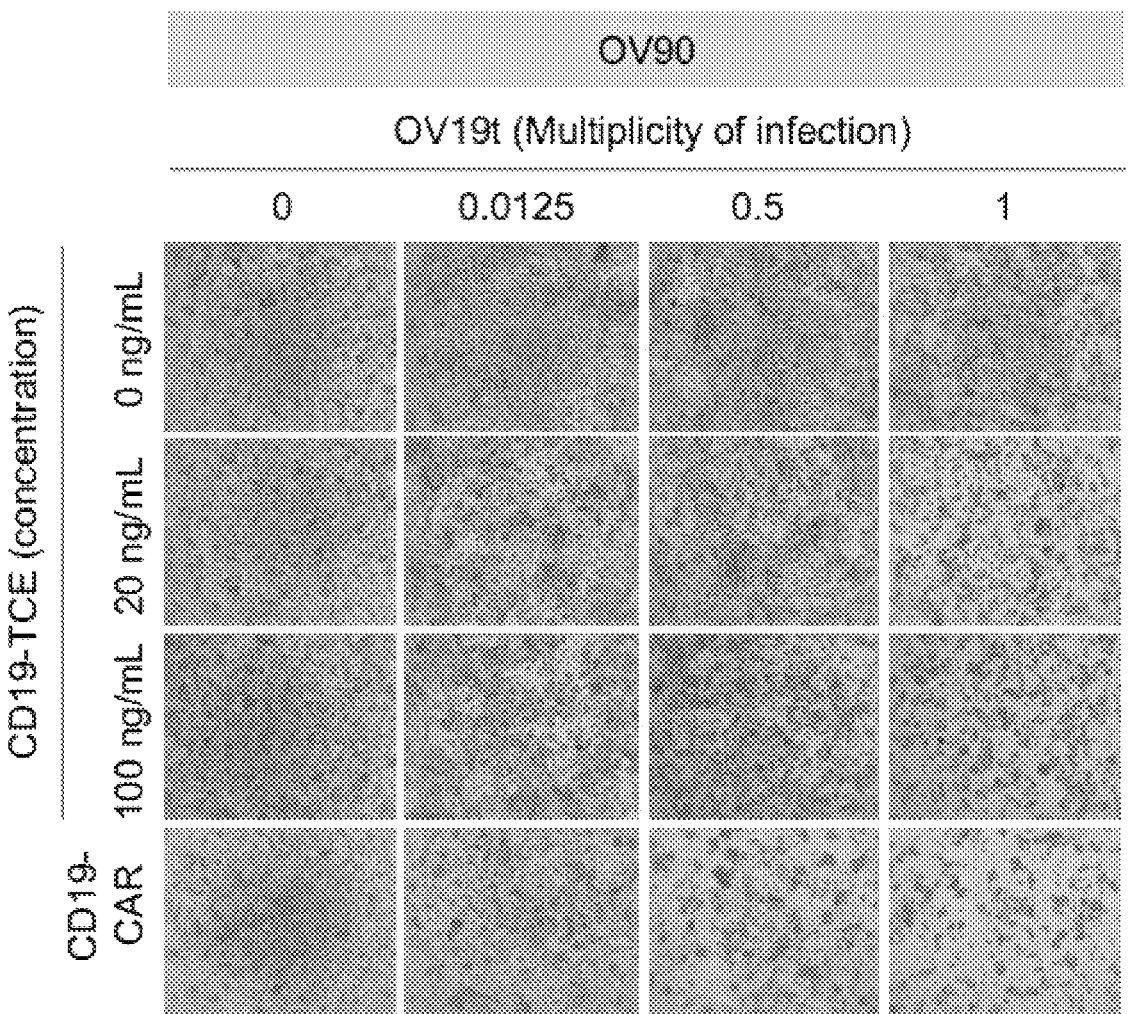
Figures 6A, 6B, 6C:
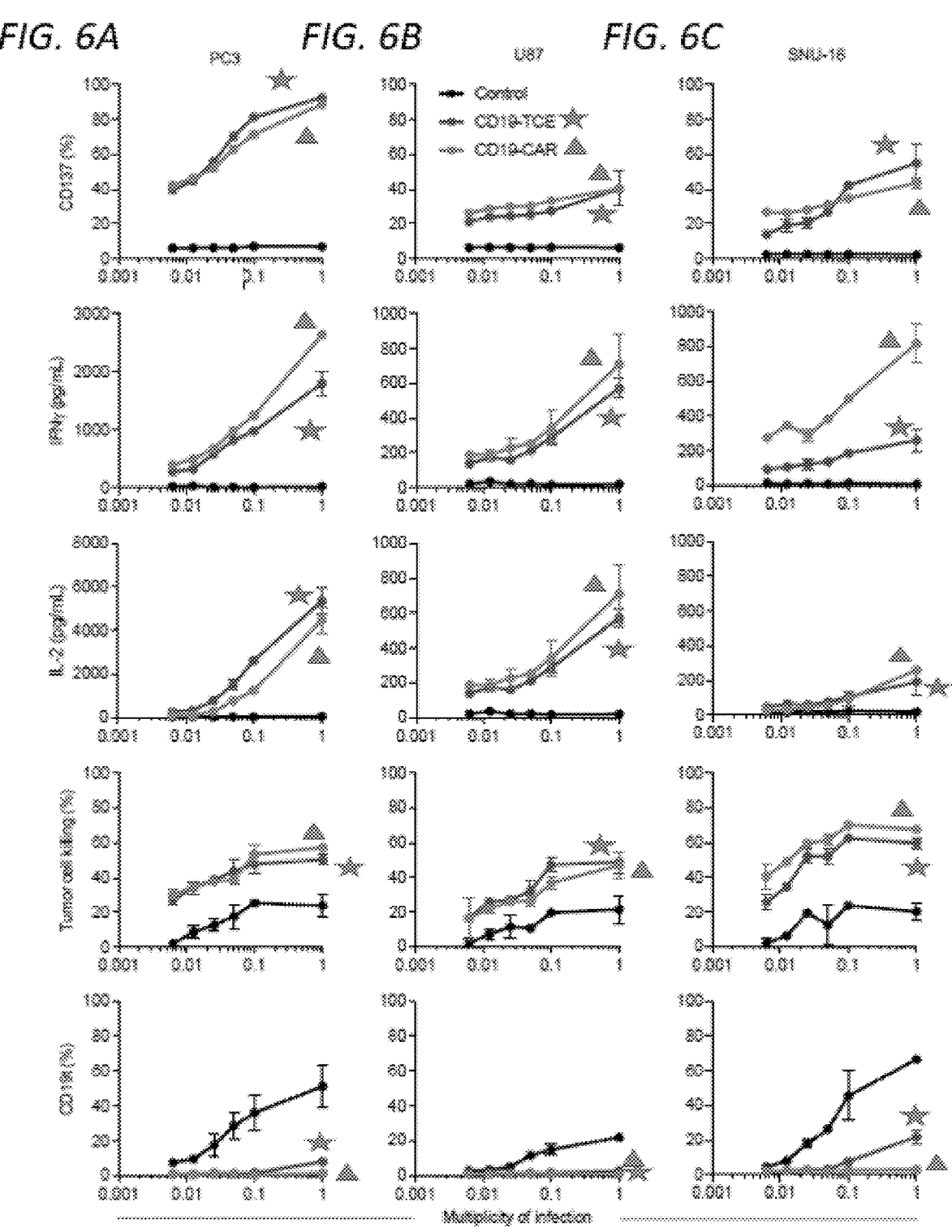
FIGS. 6A-6C. OV19t induces CD19t expression on various solid tumor cell lines, which directs activation and cytotoxicity of human T cells in the presence of CD19-TCE in vitro.

We confirmed activity of this combination comparing the FDA-approved blinatumomab to research grade CD19-TCE (Proteogenix), which demonstrated similar in vitro activity (FIG. 2A-2C). Therefore, research grade CD19-TCE was used for all subsequent studies. Similar tumor cell killing was observed against the OV90 cell line infected with OV19t and co-cultured with non-targeting T cells in the presence of either 20 or 100 ng/mL CD19-TCE when compared to OV19t-infected tumors alone (FIG. 5B). Importantly, CD19t expression was significantly reduced in tumor cells with CD19-TCE, showing on-target activity (FIG. 1G). Additional solid tumor cell lines including PC3 (prostate), U87 (glioma), and SNU-16 (gastric) were tested using this combination therapy and demonstrated similar advantages in activation, tumor cell killing, and targeting of CD19t expressing cells (FIG. 6A-6C). Taken together, our data suggest that CD19-TCE redirects T cell-mediated activation and anti-tumor activity against OV19t-infected tumor cells.

Example 2: OV19t Promotes Tumor Infiltration of Non-Targeting T Cells Following CD19-TCE Treatment OV has been previously shown to augment infiltration of T cells and other immune cells into tumors inducing endogenous anti-tumor immunity[16]. Therefore, we assessed the tumor trafficking of engrafted PBMCs lentivirally transduced to stably express firefly luciferase (ffluc) following OV19t infection with or without CD19-TCE treatment in MDA-MB-468 xenograft model.

Figure 3A:
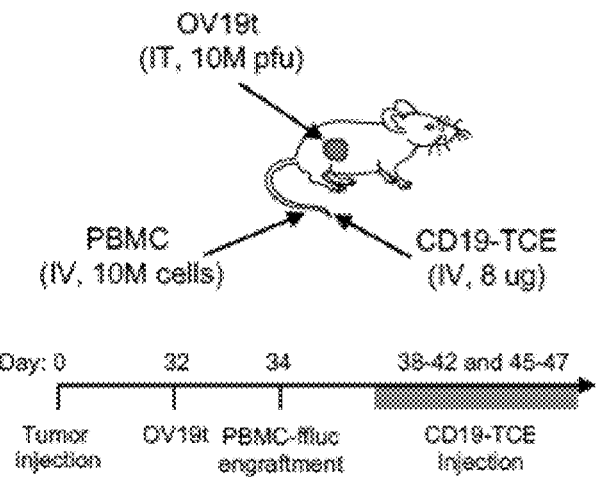
FIGS. 3A-3E. In vivo efficacy of combination therapy of CD19-TCE and OV19t in a human xenograft MDA-MB-468 tumor model.
Figure 3B:
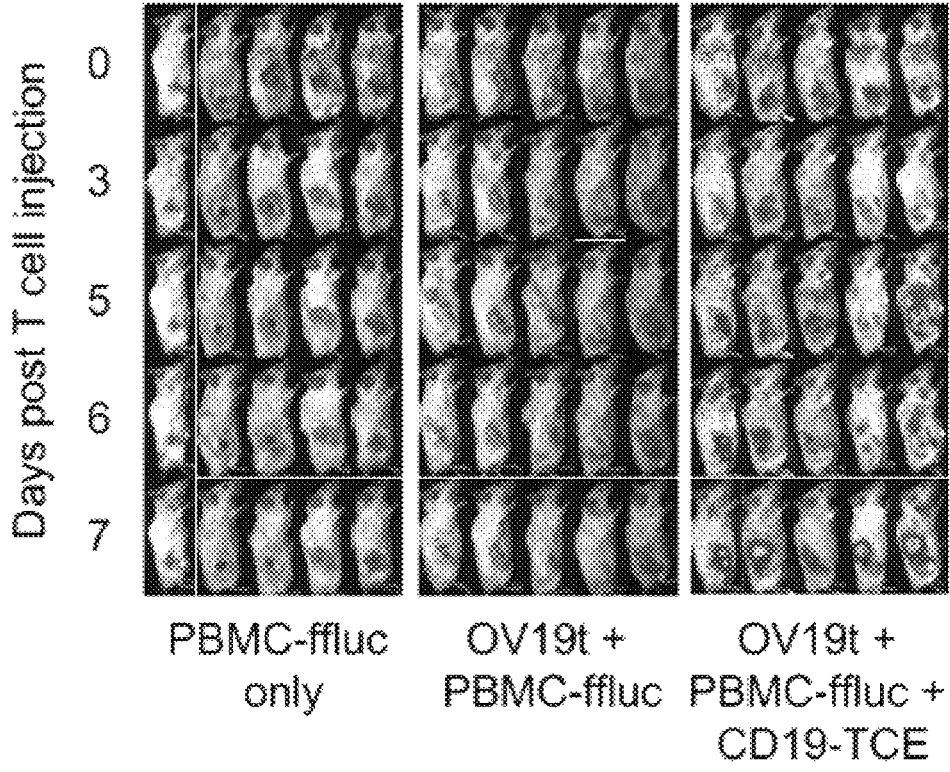
Figure 3C:
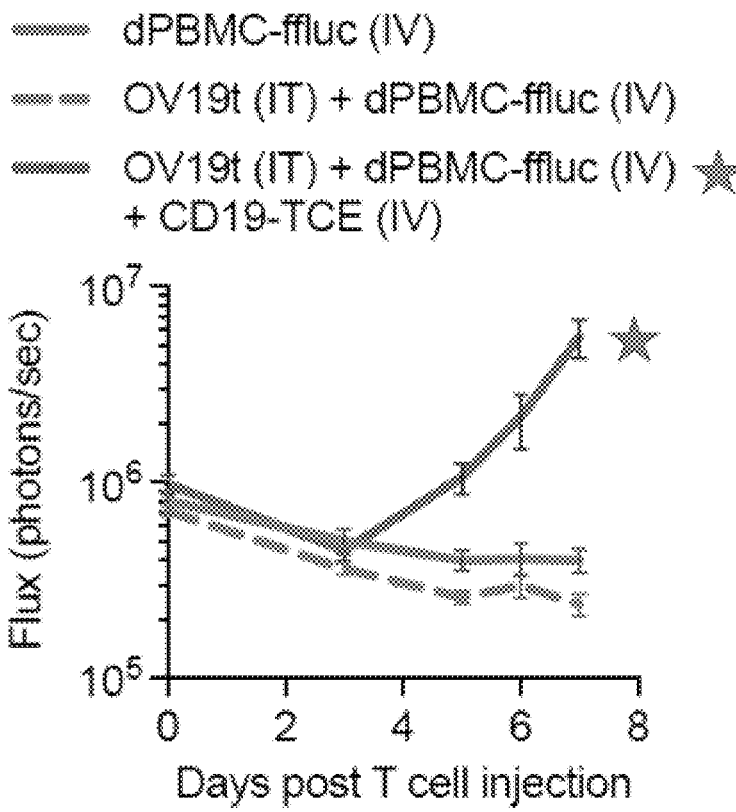
Figure 7:
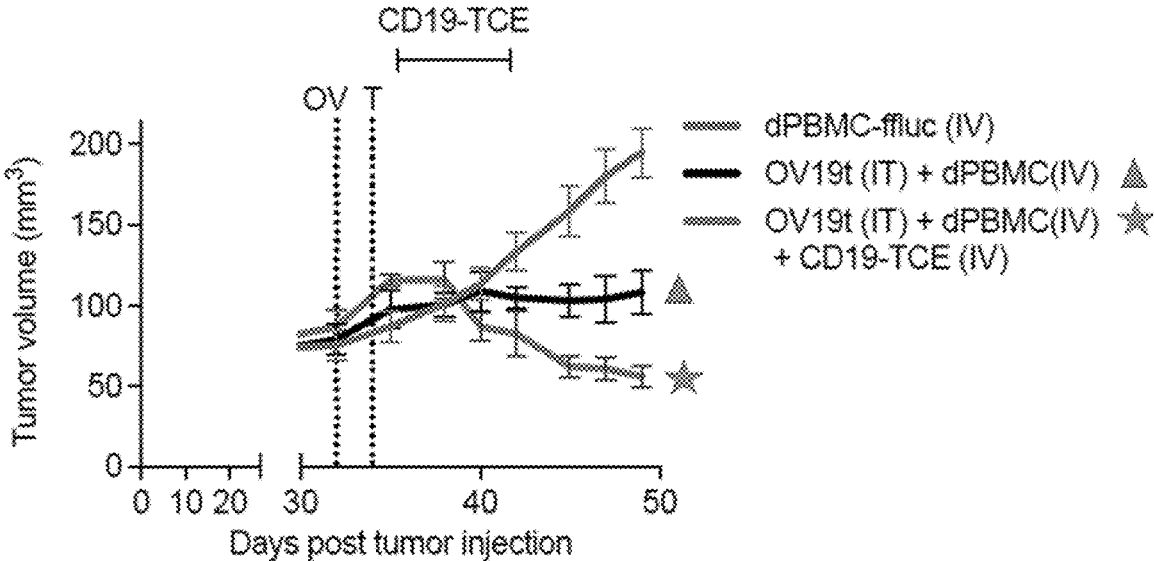
FIG. 7. Anti-tumor efficacy of combination therapy of CD19-TCE and OV19t with PBMC-ffluc engraftment in human xenograft MDA-MB-468 tumor model. NSG mice were subcutaneously injected with MDA-MB-468 ($5\times10^6$ cells) on day 0. Tumor-bearing mice were treated with IT OV19t ($1\times10^6$ pfu) on day 32, engrafted with IV PBMC-ffluc ($1\times10^7$ cells) on day 34, and treated with IV CD19-TCE (100 ug/dose, 8 times) on days 38-42 and 45-47. Tumor volumes are shown as means±SEM (n=5).

Using ffluc expressing T cells (FIG. 3A), the combination of OV19t, PBMC-ffluc, and CD19-TCE again exhibited significant tumor regression (FIG. 7). Interestingly, OV19t and CD19-TCE combination treatment induced significantly higher influx of non-targeting T cells compared to PBMC-ffluc alone or PBMC-ffluc with OV19t alone (FIGS. 3B-3C). These data suggest that CD19-TCE redirects T cells to target CD19t, enabling tumor-infiltration of endogenous T cells to target and kill tumors expressing CD19t induced by OV19t infection.

Figure 3D:
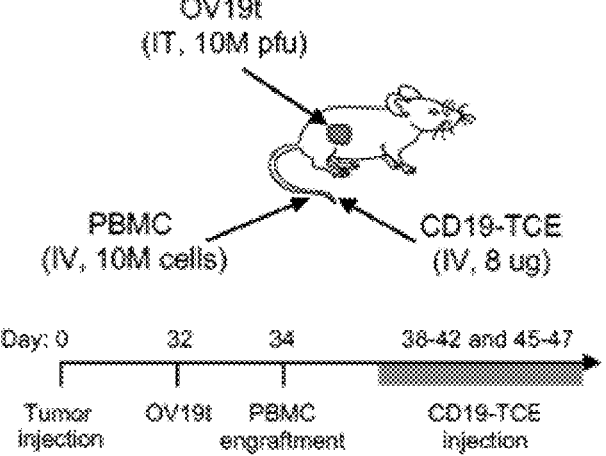
Figure 3E:
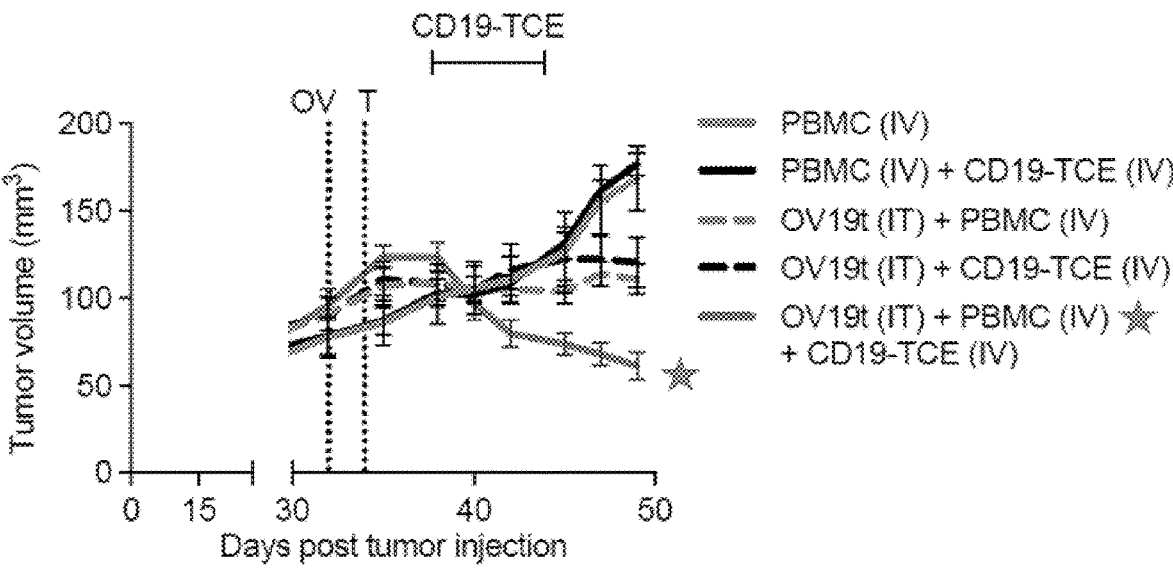

Example 3: Anti-Tumor Efficacy with the Combination of OV and TCE in Human Solid Tumor Xenograft Models To evaluate the anti-tumor activity of OV19t in combination with CD19-TCE in vivo, we treated NSG mice bearing subcutaneous MDA-MB-468 tumors with a single intratumoral injection of $10^6$ pfu OV19t as previously described[13]. Two days after OV19t treatment, we collected PBMCs from a healthy human donor and engrafted with $5 \times 10^6$ cells per mouse. Four days after PBMC transfer, mice were treated with CD19-TCE (8 ug/dose) or PBS for five consecutive days (Mon-Fri) and then three consecutive days (Mon-Wed) the following week for a total of 64 ug/mouse (FIG. 3D). Over the course of two weeks, MDA-MB-468 tumor-bearing mice treated with PBMCs alone or PBMCs and CD19-TCE showed no tumor control. Notably, mice treated with OV19t and PBMCs or OV19t and CD19-TCE slowed tumor growth as expected with OV19t alone, but we observed marked tumor regression with the combination of OV19t, PBMCs, and CD19-TCE (FIG. 3E). These studies highlight the therapeutic efficacy of combining OV and TCE in preclinical models.

Figure 4A:
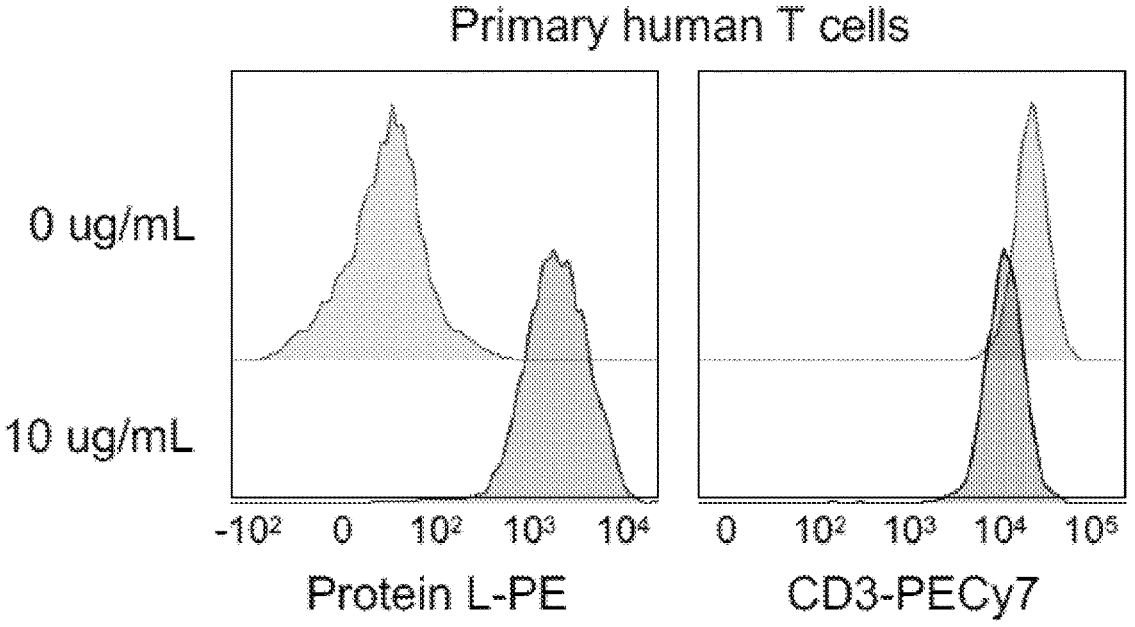
FIGS. 4A-4E. HER2-CAR T cells combined with CD19-TCE directs activation and cytotoxicity against HER2-positive and -negative tumor cells infected with OV19t.
Figure 4B:
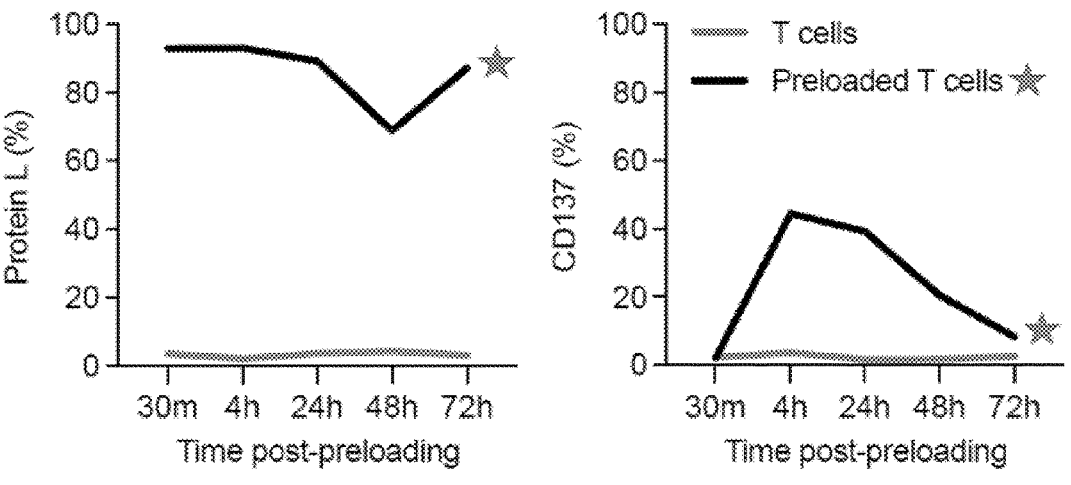
Figures 8A, 8B, 8C:
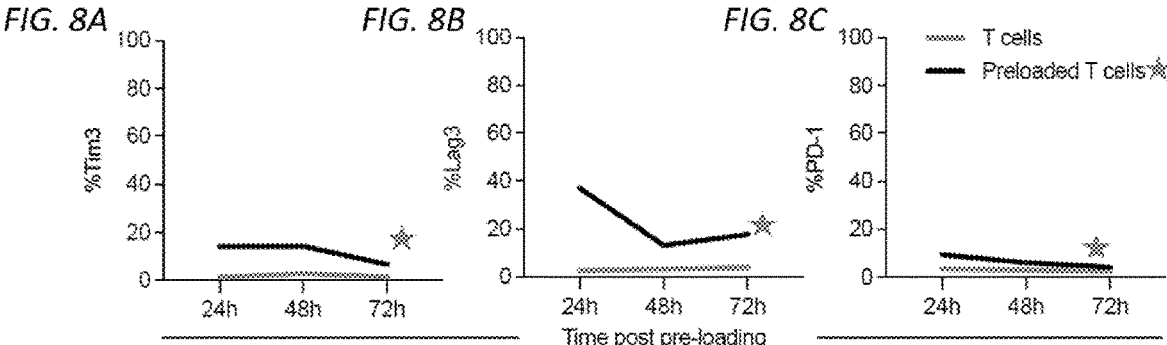
FIGS. 8A-8C. Expression of exhaustion markers on human T cells preloaded with CD19-TCE. Expression of (FIG. 8A) Tim3, (FIG. 8B) Lag3, and (FIG. 8C) PD-1 on human T cells following preloading with CD19-TCE (10 ug/mL) at 24, 48, and 72 hours.

Example 4: Antitumor Efficacy of CD19-TCE Pre-Loaded T Cells Against OV19t-Infected Solid Tumor Cells In Vitro To evaluate if CD19-TCE pre-loaded onto a non-targeting T cell has the same anti-tumor efficacy as T cells exposed to CD19-TCE in culture, we co-cultured MDA-MB-468 tumors cells infected with varying MOIs of OV19t and non-targeting T cells. To appropriate wells, 100 ng/mL CD19-TCE and 1:1 E:T with non-targeting T cells, 1:1 E:T of non-targeting T cells preloaded with 10 ug/mL CD19-TCE, or CD19-CAR T cells were added in a tumor killing assay. CD19-TCE pre-loading was confirmed prior to co-culture with tumor targets by determining shift of CD3 expression and by using biotinylated protein L and secondary streptavidin antibody staining. We demonstrated a shift in CD3 expression while confirming approximately 95-97% protein L staining on T cells preloaded with 10 ug/mL and thus continued all pre-loading experiments with a concentration of 10 ug/mL (FIG. 4A). Additionally, we performed a time course study over 72h to determine CD19-TCE binding, activation, and exhaustion following pre-loading of T cells. CD3 shift decreased (data not shown) most likely due to proliferation of T cells following activation while protein L expression remained high over 72h (FIG. 4B). After 4 hours of culturing following pre-loading of T cells with CD19-TCE, there was an initial increase in activation marker (CD137) but decreased over 72h (FIG. 4B). There was a slight increase in exhaustion markers (TIM3, LAG3, and PD-1) at 24h, but decreased over 72h (FIGS. 8A-8C).

Figure 4C:
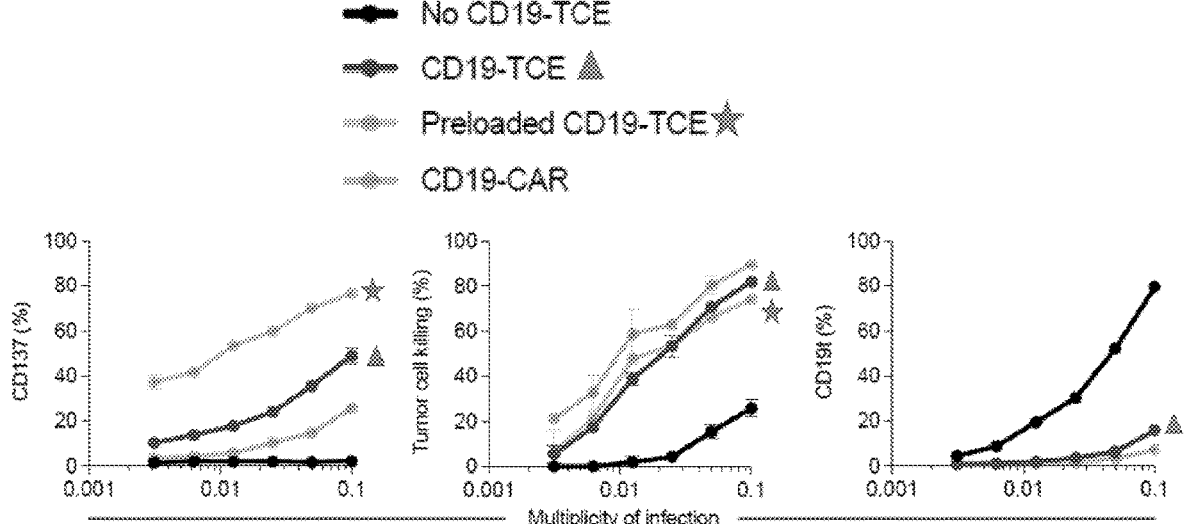
Figures 9A, 9B, 9C:
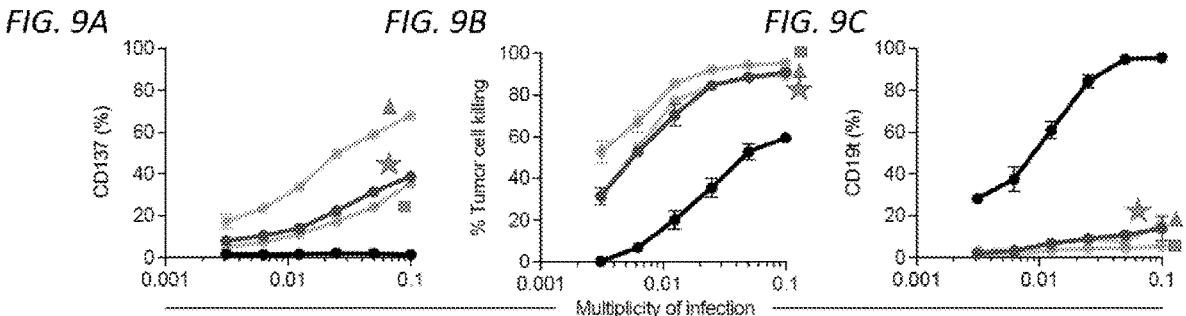
FIGS. 9A-9C. CD19t expression on tumor cells following OV19t infection directs activation and cytotoxicity of human T cells in the presence of CD19-TCE in vitro at 48 hours.

After 24 hours in culture with OV19t infected MDA-MD-468 tumor cells, we observed an increase in CD137 of preloaded non-targeting T cells when compared to non-targeting T cells with CD19-TCE added in culture and CD19-CAR T cells when accessed by flow cytometry (FIG. 4C). CD137 expression remained higher among pre-loaded T cells at 48 hours as well (FIG. 9A). We quantified T cell killing ability against MDA-MB-468 tumor cells infected with OV19t using flow cytometry. At 24 and 48 hours, we observed greater killing of non-targeting T cells with CD19-TCE in culture, CD19-TCE preloaded non-targeting T cells, and CD19-CAR T cells than OV19t with non-targeting T cells alone (FIGS. 4C and 9B). Furthermore, targeting of CD19t expression following OV19t infection by CD19-TCE was confirmed when comparing expression to co-cultured wells in the absence of CD19-TCE (FIGS. 4C and 9C). This data suggests that the presence of CD19-TCE, both pre-loaded onto T cells or suspended in culture with T cells, and CD19-CAR T cells elicit comparable anti-tumor activity against OV19t infected solid tumors in vitro.

Figure 4D:
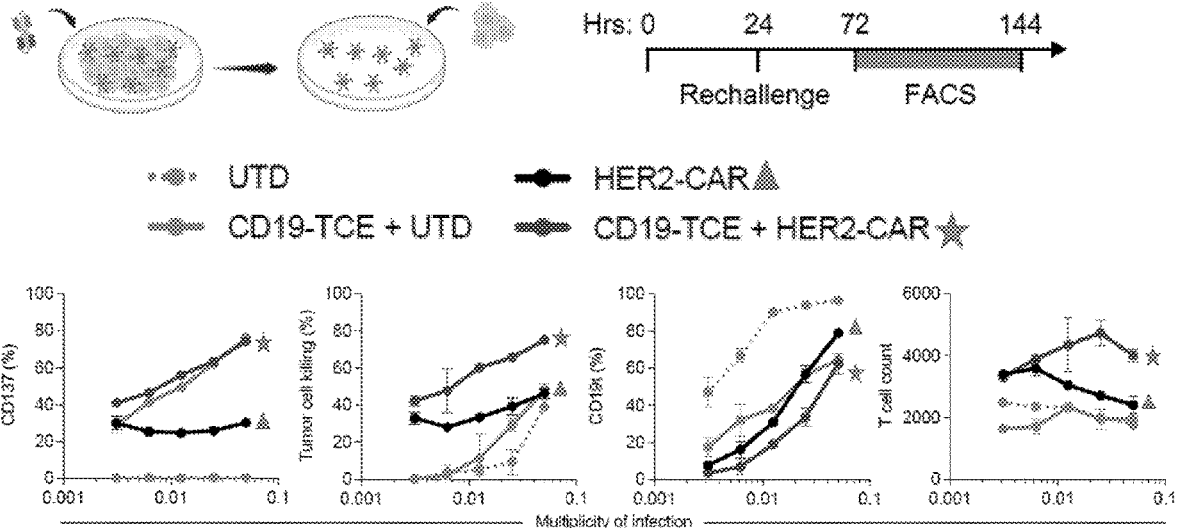
Figure 4E:
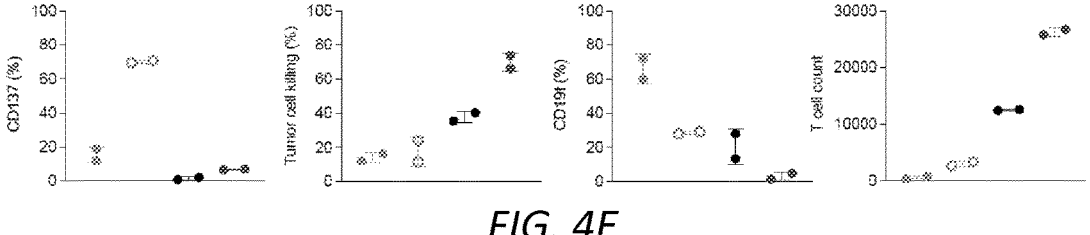
Figures 10A, 10B:
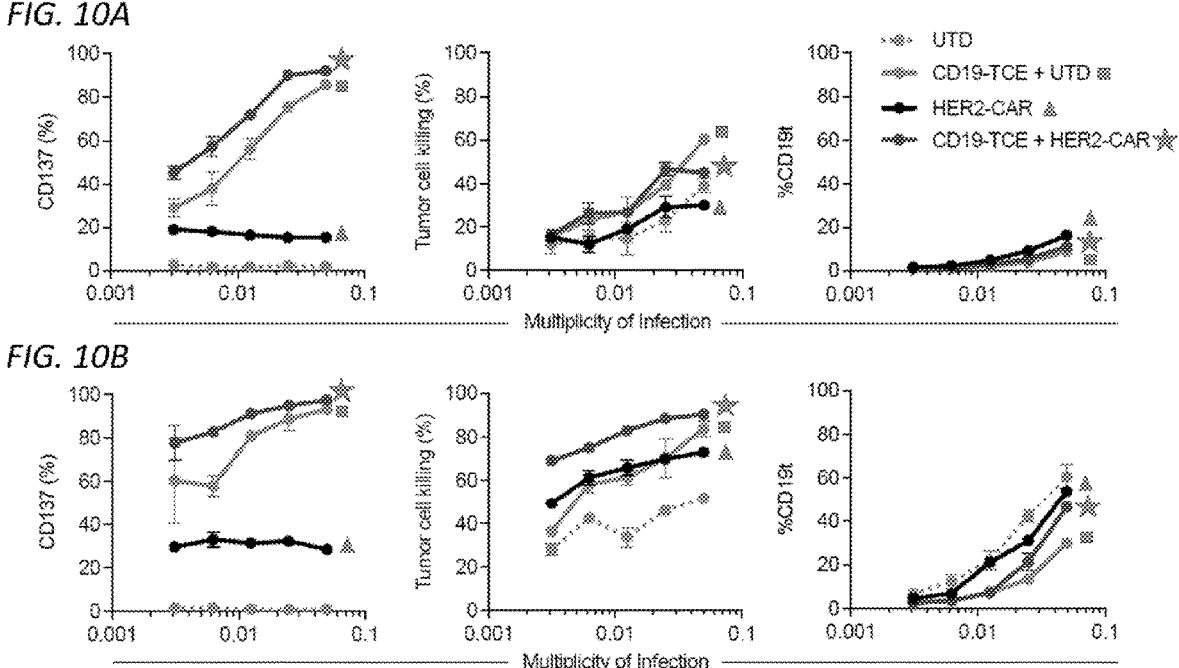
FIGS. 10A-10B. OV19t induces CD19t expression on MDA-MB-468, which directs activation and cytotoxicity of human T cells and HER2-CAR T cells in the presence of CD19-TCE in vitro. Human T cells or HER2-CAR T cells with or without CD19-TCE were added to wild-type and HER2 expressing MDA-MB-468 tumor cells (1:4 ratio) infected with indicated MOIs of OV19t. CD137 expression (left), tumor cell killing (middle), and CD19t expression (right) were quantified at (FIG. 10A) 24 and (FIG. 10B) 48 hours using flow cytometry.

Example 5: Addressing Solid Tumor Antigen Heterogeneity by Combining HER2 Targeting CAR T Cells with CD19-TCE Against a Tumor Cancer Cell Line with Low Levels of HER2 Expression Following OV19t To determine whether CD19-TCE in combination with OV19t could further improve the targeting of a CAR T cell onto a tumor with heterogenous expression patterns of an existing CAR antigen, we co-cultured MDA-MB-468 triple negative breast cancer cells with 80% of the cells belonging to the parental line and 20% of cells expressing the CAR targetable HER2 antigen (MDA-MB-468-HER2 was lentivirally transduced to stably express HER2). We then treated wells with varying MOIs of OV19t and added HER2 CAR T cells with or without CD19-TCE. These cells were co-cultured for 1-6 days, which were rechallenged as shown in FIG. 4D. At 24h, OV19t and HER2 CAR T cells showed comparable killing to OV19t with HER2 CAR T cells and CD19-TCE (FIG. 10A). At 48h, CD19-TCE in combination with HER2 CAR T cells demonstrated slightly higher killing, but similar activation and CD19t targeting (FIG. 10B). When wells were rechallenged with antigen negative MDA-MB-468 tumor cells (not expressing HER2), the combinatorial treatment of OV19t, HER2 CAR T cells, and CD19-TCE showed additive and synergistic tumor cell killing when compared to OV19t and HER2 CAR T cells alone. Additionally, both non-targeting T cells with CD19-TCE (FIG. 4D). Wells were then rechallenged once more with antigen negative MDA-MB-468 tumor cells and again showed improved tumor cell killing when a combinatorial approach using OV19t, HER2 CAR T cells, and CD19-TCE. We demonstrated greater tumor cell killing, CD19t targeting, and T cell count at the lowest MOI (0.003125) (FIG. 4E). This data suggests that using OV19t to deliver a CD19-TCE-targetable antigen can be combined with existing CAR T cells to elicit dual-targeting of heterogenous tumors.

REFERENCES

1. Huehls, A. M., T. A. Coupet, and C. L. Sentman, *Bispecific T-cell engagers for cancer immunotherapy*. Immunol Cell Biol, 2015. 93(3): p. 290-6.
2. Goebeler, M. E. and R. C. Bargou, *T cell-engaging therapies—BiTEs and beyond*. Nat Rev Clin Oncol, 2020. 17(7): p. 418-434.
3. Kantarjian, H., et al., *Blinatumomab versus Chemotherapy for Advanced Acute Lymphoblastic Leukemia*. N Engl J Med, 2017. 376(9): p. 836-847.
4. Bargou, R., et al., *Tumor regression in cancer patients by very low doses of a T cell-engaging antibody*. Science, 2008. 321(5891): p. 974-7.
5. Stern, L. A., V. D. Jonsson, and S. J. Priceman, *CAR T Cell Therapy Progress and Challenges for Solid Tumors*. Cancer Treat Res, 2020. 180: p. 297-326.
6. Hamieh, M., et al., *Programming CAR T Cell Tumor Recognition: Tuned Antigen Sensing and Logic Gating*. Cancer Discov, 2023. 13(4): p. 829-843.
7. Sterner, R. C. and R. M. Sterner, *CAR-T cell therapy: current limitations and potential strategies*. Blood Cancer J, 2021. 11(4): p. 69.
8. Chen, N., et al., *Driving CARs on the uneven road of antigen heterogeneity in solid tumors*. Curr Opin Immunol, 2018. 51: p. 103-110.
9. Murad, J. P., et al., *Pre-conditioning modifies the TME to enhance solid tumor CAR T cell efficacy and endogenous protective immunity*. Mol Ther, 2021. 29(7): p. 2335-2349.
10. Bonaventura, P., et al., *Cold Tumors: A Therapeutic Challenge for Immunotherapy*. Front Immunol, 2019. 10: p. 168.
11. Young, R. M., et al., *Next-Generation CAR T-cell Therapies*. Cancer Discov, 2022. 12(7): p. 1625-1633.
12. Kaufman, H. L., F. J. Kohlhapp, and A. Zloza, *Oncolytic viruses: a new class of immunotherapy drugs*. Nat Rev Drug Discov, 2015. 14(9): p. 642-62.

13. Park, A. K., et al., *Effective combination immunotherapy using oncolytic viruses to deliver CAR targets to solid tumors*. Sci Transl Med, 2020. 12(559).

14. Kim, S. I., et al., *Recombinant Orthopoxvirus Primes Colon Cancer for Checkpoint Inhibitor and Cross-Primes T Cells for Antitumor and Antiviral Immunity*. Mol Cancer Ther, 2021. 20(1): p. 173-182.

15. Yang, A., et al., *Development of the oncolytic virus, CF33, and its derivatives for peritoneal-directed treatment of gastric cancer peritoneal metastases*. J Immunother Cancer, 2023. 11(4).

16. Ribas, A., et al., *Oncolytic Virotherapy Promotes Intratumoral T Cell Infiltration and Improves Anti-PD-1 Immunotherapy*. Cell, 2017. 170(6): p. 1109-1119 e10.

17. Papathanasiou, M. M., et al., *Autologous CAR T-cell therapies supply chain: challenges and opportunities-?*Cancer Gene Ther, 2020. 27(10-11): p. 799-809.

18. Goebeler, M. E. and R. Bargou, *Blinatumomab: a CD19 CD3 bispecific T cell engager (BiTE) with unique anti-tumor efficacy*. Leuk Lymphoma, 2016. 57(5): p. 1021-32.

19. Moreau, P., et al., *Teclistamab in Relapsed or Refractory Multiple Myeloma*. N Engl J Med, 2022. 387(6): p. 495-505.

20. Daei Sorkhabi, A., et al., *The current landscape of CAR T-cell therapy for solid tumors: Mechanisms, research progress, challenges, and counterstrategies*. Front Immunol, 2023. 14: p. 1113882.

21. Wang, X., et al., *Phase 1 studies of central memory-derived CD19 CAR T-cell therapy following autologous HSCT inpatients with B-cell NHL*. Blood, 2016. 127(24): p. 2980-90.

22. Priceman, S. J., et al., *Regional Delivery of Chimeric Antigen Receptor—Engineered T Cells Effectively Targets HER2(+) Breast Cancer Metastasis to the Brain*. Clin Cancer Res, 2018. 24(1): p. 95-105.

23. Priceman, S. J., et al., *Co-stimulatory signaling determines tumor antigen sensitivity and persistence of CAR T cells targeting PSCA+ metastatic prostate cancer*. Onco-immunology, 2018. 7(2): p. e1380764.

24. Voynov, V., et. al., *Discovery Strategies to Maximize the Clinical Potential of T-Cell Engaging Antibodies for the Treatment of Solid Tumors*. Antibodies (Basel), 2020 Dec. 9(4): p. 65.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (935 sequences)

SEQ ID NO: 1 - DNA, 182474 bp, synthetic construct
  source 1..182474: mol_type = other DNA
ttccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaactcatgatgaagttgagaatgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagcatacagtaagcatagatacgtaaaatctcaaattgtgcatctactgatatccagctattcgaattcctctaacgaactcaagtcgaatataaatgatttcgatctgtattcgtatatgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcggattatctaaacaagcgatttagagtaaccccatataatgtagacatggaaatcgttaatcttcttattgagagacgtcatactcttgtcgacgtaatgcgtagtattacttcttagtggtcgtccgagtacacgatgtgtcgttgacgggatacagattaatttccacatcgatatagttaaaggtatttctgggtacgggtttgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagtccatcctcgtcgacgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataaactccgtgtttatgatcatttttaacagcaacacattcaatattgtattgttttattttatattatttacacaattaacaatatattattagtttatattactgaattaataatataaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattatttttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagtttccacactattcttaaattttatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctaacatcgacgcattatatagttttttaattccatattgtttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtaaaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctactgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtggtgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacaacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggctcttcttaattcatcttctatataaggccaaaacaaaatattgcctgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggggtgttaatcttgggaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgcccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgagatgaaatgatgatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttattacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacagggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaattcaaatagatgttcatcatataatcgtcgctataattcatattaatactttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctattcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttaaacgagctcaaaaattgaaaaactagcgtctttttttgctcgaagtcgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgccctgccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagatgattaattaatttttatggatccgctagcggccgcggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagttgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagatcaaaattaacaaaattaaaggagcatgtatttttttctgaatatattgtgactccagataaatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttagatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatatttttttttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagcccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctatagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgaagtagtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcagattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatgataaaacgattagatggaccatctaataaatatcatatatatactgagaagttattatctgtagacgagcctagaaatcaacttattcttgataccctggtagaagaattcaagtcaggaactattaatcgcattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacgccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttctcatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaacttcagcttctaggacggcgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcagcattggtttcattattacgtctacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagttggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttaatagaagagcgaatatctcgtctgacttaatgagacgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtaaatctcccatgtggcggaatactaccatctatcgcatgtggatggacagtaggtaatggccatgggaacagtaatgattgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagcggtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaaacctgggaggaaggacgtaatgcatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaactaaaaaacggaaatatatttgtagtacaacgaatactcccaaactgcattcgtgttacactatataacaattacactacatttttatcataacactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagtcggattatgtgagtactggattgtatattttattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataataaatactttttatttacggtactcttgtagtggtgataccctactcaattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaacgccgcctcattgtcgcttatattgatgatgtcgaattctcccaatatcatcactgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctttaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatgaatgtttccttttttaccaaaggaaatgcctcgttgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatataaatctaaaattgatggataagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaactcataattgctgacgcgataaattcgtaataatctgttttgttcaaatttttataaggaatctacaggcataaaaataaaaatataatttataatatactcttacagcgcgccatcatgaatagcagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacgaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgctacagatcccaaatctggtaaaagttaaacttggggagaatgatacagaaaatctttcttctactatatcggcggcaccatcgaggtaaccacctctcaagaagaccgcgtgaataatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataggttgtaatatcatatagacaataactaacaattaattagtaactgttatctcttttttaactaaccaactaactatatacctattaatacatcgtaattatagttcttaacatctattaatcattgattcgcttctttaattttttataaactaacattgttaattgaaaagggataacatgttacagaatataaattatatatggatttttttaaaaaggaaatacttgactggagtgtatatttatctcttcattatatagcacgcgtgtgttccaattcttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgcagaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacatttacatgtgatcagggatatcattctttggatccaaatgctgtctgcgaaacagataaatggaaatacgaaaatccatgcaagaaaatgtgcacagtttctgattatgtctctgaattatatgataagccattatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcaacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatacaagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaaaatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgatgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggttcgtataatcttgtggatactctagtaaagtcaggactgacagaggtgttcggttcaactggagattatagcaatatgtgtaattcagatgtgagtgtcgacgctatgattcacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacagttgtattccacactcctctcttttagagatgatgcggaatcagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccgtataccatcgattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcactgatagagaacatataaatatagactctattaaacagttgtgtaaaatatcaaatcctaatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatggaagacattacctaacttctggactggaactataaatccaggcgtggtctcgcataaagatgatatatatgttgtatgcgacatcaaagatgaaaaaaatgttaagacttgtatatttagatataacacgaatacgtataacggatgggaattggttacgacgacagaaagcagattatcagctctgcatactattcttcatgacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttattgtttggtctataccatggatatctttaaagaactaatcttaaaacaccctgatgaaaatgttttgatttctccagtttctattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacgatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattga

SEQ ID NO: 2 - DNA, 189404 bp, synthetic construct
  source 1..189404: mol_type = other DNA
gagaaagagataaaacttttttacgactccatcagaaagaggtttaatatttttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaaaatatttttgtaaaactttttttatgagaccatcagaaagaggtttaatatttttgtgataccctgaaaggaaataggaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaatcctgaagttgctaccttattaagaacggagaagtatccatcacgaaagacgggattacagtctttatgattcatagtaatagttagttccgacgttgagatggattcgctgagaccggtagtggtcgtccgagtacacgatgtgtcgttgacgggatacagattaatttccacatcgatatagttaaaggtatttctgggtacgggtttgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagtccatcctcgtcgacgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatcatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattatttttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagtttccacactattcttaaattttatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctaacatcgacgcattatatagttttttaattccatattgtttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtaaaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctactgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtggtgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacaacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggctcttcttaattcatcttctatataaggccaaaacaaaatattgcctgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggggtgttaatcttgggaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgcccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatatggtaatgaccattaaaataaaaatattcttcataaccggtaagaaagtgaaaagttcacattgaaactatgtcagtagtatacatcatgaaatgagatgaaatgatgatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttattacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacagggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaattcaaatagatgttcatcatataatcgtcgctataattcatattaatactttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttaaacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagataaaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagttgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagatcaaaattaacaaaattaaaggagcatgtatttttttctgaatatattgtgactccagataaatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttagatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatatttttttttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagcccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctatagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgaagtagtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcagattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatgataaaacgattagatggaccatctaataaatatcatatatatactgagaagttattatctgtagacgagcctagaaatcaacttattcttgataccctggtagaagaattcaagtcaggaactattaatcgcattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacgccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttctcatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaacttcagcttctaggacggcgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcagcattggtttcattattacgtctacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagttggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttaatagaagagcgaatatctcgtctgacttaatgagacgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtaaatctcccatgtggcggaatactaccatctatcgcatgtggatggacagtaggtaatggccatgggaacagtaatgattgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagcggtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaaacctgggaggaaggacgtaatgcatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaactaaaaaacggaaatatatttgtagtacaacgaatactcccaaactgcattcgtgttacactatataacaattacactacatttttatcataacactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagtcggattatgtgagtactggattgtatattttattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataataaatactttttatttacggtactcttgtagtggtgataccctactcaattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaacgccgcctcattgtcgcttatattgatgatgtcgaattctcccaatatcatcactgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctttaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatgaatgtttccttttttaccaaaggaaatgcctcgttgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatataaatctaaaattgatggataagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaactcataattgctgacgcgataaattcgtaataatctgttttgttcaaatttttataaggaatctacaggcataaaaataaaaatataatttataatatactcttacagcgcgccatcatgaatagcagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacgaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgctacagatcccaaatctggtaaaagttaaacttggggagaatgatacagaaaatctttcttctactatatcggcggcaccatcgaggtaaccacctctcaagaagaccgcgtgaataatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataggttgtaatatcatatagacaataactaacaattaattagtaactgttatctcttttttaactaaccaactaactatatacctattaatacatcgtaattatagttcttaacatctattaatcattgattcgcttctttaattttttataaactaacattgttaattgaaaagggataacatgttacagaatataaattatatatggatttttttaaaaaggaaatacttgactggagtgtatatttatctcttcattatatagcacgcgtgtgttccaattcttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgcagaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacatttacatgtgatcagggatatcattctttggatccaaatgctgtctgcgaaacagataaatggaaatacgaaaatccatgcaagaaaatgtgcacagtttctgattatgtctctgaattatatgataagccattatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcaacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatacaagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaaaatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgatgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggttcgtataatcttgtggatactctagtaaagtcaggactgacagaggtgttcggttcaactggagattatagcaatatgtgtaattcagatgtgagtgtcgacgctatgattcacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacagttgtattccacactcctctcttttagagatgatgcggaatcagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccgtataccatcgattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcactgatagagaacatataaatatagactctattaaacagttgtgtaaaatatcaaatcctaatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatggaagacattacctaacttctggactggaactataaatccaggcgtggtctcgcataaagatgatatatatgttgtatgcgacatcaaagatgaaaaaaatgttaagacttgtatatttagatataacacgaatacgtataacggatgggaattggttacgacgacagaaagcagattatcagctctgcatactattcttcatgacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttattgtttggtctataccatggatatctttaaagaactaatcttaaaacaccctgatgaaaatgttttgatttctccagtttctattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacgatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaactcatgatgaagttgagaatgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagcatacagtaagcatagatacgtaaaatctcaaattgtgcatctactgatatccagctattcgaattcctctaacgaactcaagtcgaatataaatgatttcgatctgtattcgtatatgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcggattatctaaacaagcgatttagagtaaccccatataatgtagacatggaaatcgttaatcttcttattgagagacgtcatactcttgtcgacgtaatgcgtagtattacttcttacgattccagagactataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaataatggacacatggctgtaaatcacgtatcgaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaggatagttgatttattacttagctaccatcccactctagagactatgattgacgcatttaatagagatatacgctatctatatcctgaaccattattcgcctgtatcagatacgccttaatcctagatgatgattttccttctaaagtaagtatgatatctccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttctgtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgtcgacgaggatggactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcaaacccgtacccagaaatacctttaactatatcgatgtggaaattaatctgtatcccgtcaacgacacatcgtgtactcggacgaccactaccggtctcagcgaatccatctcaacgtcggaactaactattactatgaatcataaagactgtaatcccgtctttcgtgatggatacttctccgttcttaataaggtagcaacttcaggattctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctattcctatttcctttcagggtatcacaaaaatattaaacctctttctgatggtctcataaaaaaagttttacaaaaatatttttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctc

SEQ ID NO: 3 - protein, 323 aa, synthetic construct
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKR

SEQ ID NO: 4 - protein, 302 aa, synthetic construct
EPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKR

SEQ ID NO: 5 - DNA, 190949 bp, synthetic construct
  source 1..190949: mol_type = other DNA
gagaaagagataaaacttttttacgactccatcagaaagaggtttaatatttttgtgagaccatcgaagagagaaagagataaaattttttacgactcatagaaagagtttaatattttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagaataaaaattttttacgactccatcagaaagaggtttaatatttttgtgagaccatcgaagagagaaagagataaaattttttacatccatcagaaagagtaatatttttgtgagaccatcaaagagagaaagagaataaaaaattaaaatttttatgagaccatcaagagagaaagagataaaacttttttacgactccatcagaaagaggtttaatatttatgagaccatcaaagaaaagagaataaaaatatattttatgagaccatcaaagagagaaagagaataaaaatattttgtaaaattttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatattttttgagaccatcaaagagaaagagaataaaaatatttttgtaaaacttttttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatattttatgactccattgaagagagaatgagaataaaaatattttgtaaaagttttttttgagaccatcaaagagagaaagagaataaaaatatttttgtgagaccatcaaagagagaaagagaataaaaatattttatgactccatgaagagagaaagagaataaaaatattttatgaaccatcagaaaagagtttaatattttttatgagaccatcaaagagagaaagagaataaaaatattttgtaaaacttttatgagaccatcaaagagagaaagagaataaaaatattttatgacaccatcagaaagagttaatatttttatgagaccatcaaagagagaaagagaataaaaatattttttatgagaccatcaaagagagaaagagaataaaaatattttttatgagaccatcaaagagagaaagagaataaaaaatattttatgagaccatcaaagagagaaagagaataaaaatatttttgtatgagaccatcaaagagagaaagagaataaaaatatttttggtaaaactttttttatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaatcctgaagttgctaccttattaagaacggagaagtatccatcacgaaagacgggattacagtctttatgattcatagtaatagttagttccgacgttgagatggattcgctgagaccggtagtggtcgtccgagtacacgatgtgtcgttgacgggatacagattaatttccacatcgatatagttaaaggtatttctgggtacgggtttgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagtccatcctcgtcgacgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatcatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagaggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatgggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattattttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagtttccacactattcttaaattttatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctaacatcgacgcattatatagttttttaattccatattgtttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtaaaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctactgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtggtgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacaacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggctcttcttaattcatcttctatataaggccaaaacaaaatattgcctgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcgggggtgttaatcttgggaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgcccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggaggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgagatgaaatgatgatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattatttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttattacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatatttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacagggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtattttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttcttttattctcgttaaacagcatttctgtcaacggaccccaacatcgttgaccgattaagttttgattgatttttccgtgtaaggcgtatctagtcagatcgtatagcctatccaataatccatcgtctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaattttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattccttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattcccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatatttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaattcaaatagatgttcatcatataatcgtcgctataattcatattaatactttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactatttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgatttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagcctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaagaatcctctctagctaccaccgcaatagatcctattagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttaaacgagctcaaaaattgaaaaactagcgtctttttttgctcgaagtcgaccaccatgccacctcctcgcctcctcttcttcctcctcttcctcaccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatgggggcttctacctgtgccagccgggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccagggcccctctcctggacccatgtgcaccccaagggcctaagtcattgctgagcctagagctgaaggacgatcgccctgccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagatgattaattaatttttatggatccgctagcggccgcggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattatttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatattttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttgggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagttgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagatcaaaattaacaaaattaaaggagcatgtattttttctgaatatattgtgactccagataaatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttagatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacactttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttcccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgacttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgattttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctatagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgcccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgaagtagtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaatttttttatccgccatttagaagctaaaaatatttttatttatgcagaagatttaactagattatacaatgaactaatatgatccttttccagattatttacaaacttggtattttttggttctggaggaggcgaatttaaattcggacttggattcagattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatgataaaacgattagatggaccatctaataaatatcatatatatactgagaagttattatctgtagacgagcctagaaatcaacttattcttgataccctggtagaagaattcaagtcaggaactattaatcgcattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacgccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttctcatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaacttcagcttctaggacggcgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcagcattggtttcattattacgtctacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagttggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattaggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttaatagaagagcgaatatctcgtctgacttaatgagacgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtaaatctcccatgtggcggaatactaccatctatcgcatgtggatggacagtaggtaatggccatgggaacagtaatgattgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtctttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagcggtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatatatgtttatatttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatcccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaaacctgggaggaaggacgtaatgcatgcaaagctctaaatccaaattcggatctaattaagatagagactccaaacgagttaagtttttaagaagccttagacgaggctattgggtaggagaatccgaaatattaaaccagacaacccatataattttatagctaaaaatgccacgaagaatggaactaaaaaacggaaatatatttgtagtacaacgaatactcccaaactgcattcgtgttacactatataacaattacactacatttttatcataacactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagtcggattatgtgagtactggattgtatattttattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataataaatacttttatttacggtactcttgtagtggtgataccctactcaattatttttttaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaacgccgcctcattgtcgcttatattgatgatgtcgaattctcccaatatcatcactgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctttaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatgaatgtttccttttttaccaaaggaaatgcctcgttgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatataaatctaaaattgatggataagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaactcataattgctgacgcgataaattcgtaataatctgttttgttcaaatttttataaggaatctacaggcataaaaataaaaatataatttataatatactcttacagcgcgccatcatgaatagcagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacgaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacacctttcctcagacatctaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgctacagatcccaaatctggtaaaagttaaacttggggagaatgatacagaaaatctttcttctactatatcggcggcaccatcgaggtaaccacctctcaagaagaccgcgtgaataatgtactcatgaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataggttgtaatatcatatagacaataactaacaattaattagtaactgttatctcttttttaactaaccaactaactatatacctattaatacatcgtaattatagttcttaacatctattaatcattgattcgcttctttaatttttataaactaacattgttaattgaaaagggataacatgttacagaatataaattatatatggatttttttaaaaaggaaatacttgactggagtgtatatttatctcttcattatatagcacgcgtgtgttccaattcttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgcagaagacagttacggttgtacattattacatagatgtatatatcactataagaaatcagaatcagaatcatacaatgaattaattaagatattgttaaataatggatccgatgtagataaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacatttacatgtgatcagggatatcattctttggatccaaatgctgtctgcgaaacagataaatggaaatacgaaaatccatgcaagaaaatgtgcacagtttctgattatgtctctgaattatatgataagccattatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcaacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatacaagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaaaatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgatgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggttcgtataatcttgtggatactctagtaaagtcaggactgacagaggtgttcggttcaactggagattatagcaatatgtgtaattcagatgtgagtgtcgacgctatgattcacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccatttttttaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacagttgtattccacactcctctcttttagagatgatgcggaatcagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaattttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccgtataccatcgattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcactgatagagaacatataaatatagactctattaaacagttgtgtaaaatatcaaatcctaatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatggaagacattacctaacttctggactggaactataaatccaggcgtggtctcgcataaagatgatatatatgttgtatgcgacatcaaagatgaaaaaaatgttaagacttgtatatttagatataacacgaatacgtataacggatgggaattggttacgacgacagaaagcagattatcagctctgcatactattcttcatgacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttattgtttggtctataccatggatatctttaaagaactaatcttaaaacaccctgatgaaaatgttttgatttctccagtttctattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacgatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaactcatgatgaagttgagaatgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagcatacagtaagcatagatacgtaaaatctcaaattgtgcatctactgatatccagctattcgaattcctctaacgaactcaagtcgaatataaatgatttcgatctgtattcgtatatgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcggattatctaaacaagcgatttagagtaaccccatataatgtagacatggaaatcgttaatcttcttattgagagacgtcatactcttgtcgacgtaatgcgtagtattacttcttacgattccagagactataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaataatggacacatggctgtaaatcacgtatcgaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaggatagttgatttattacttagctaccatcccactctagagactatgattgacgcatttaatagagatatacgctatctatatcctgaaccattattcgcctgtatcagatacgccttaatcctagatgatgattttccttctaaagtaagtatgatatctccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgtcgacgaggatggactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcaaacccgtacccagaaatacctttaactatatcgatgtggaaattaatctgtatcccgtcaacgacacatcgtgtactcggacgaccactaccggtctcagcgaatccatctcaacgtcggaactaactattactatgaatcataaagactgtaatcccgtctttcgtgatggatacttctccgttcttaataaggtagcaacttcaggattctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcataaaaaaagttttacaaaaatatttttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctc

SEQ ID NO: 6-14 - skipped (9 entries)

SEQ ID NO: 15 - protein, 21 aa, Homo sapiens
LCYLLDGILFIYGVILTALFL

SEQ ID NO: 16 - protein, 27 aa, Homo sapiens
FWVLVVVGGVLACYSLLVTVAFIIFWV

SEQ ID NO: 17 - protein, 28 aa, Homo sapiens
MFWVLVVVGGVLACYSLLVTVAFIIFWV

SEQ ID NO: 18 - protein, 22 aa, Homo sapiens
MALIVLGGVAGLLLFIGLGIFF

SEQ ID NO: 19 - protein, 21 aa, Homo sapiens
IYIWAPLAGTCGVLLLSLVIT

SEQ ID NO: 20 - protein, 23 aa, Homo sapiens
IYIWAPLAGTCGVLLLSLVITLY

SEQ ID NO: 21 - protein, 24 aa, Homo sapiens
IYIWAPLAGTCGVLLLSLVITLYC

SEQ ID NO: 22 - protein, 27 aa, Homo sapiens
IISFFLALTSTALLFLLFFLTLRFSVV

SEQ ID NO: 23 - protein, 21 aa, Homo sapiens
PFFFCCFIAVAMGIRFIIMVA

SEQ ID NO: 24 - protein, 10 aa, synthetic construct
GGGSSGGGSG

SEQ ID NO: 25 - protein, 12 aa, synthetic construct
ESKYGPPCPPCP

SEQ ID NO: 26 - protein, 12 aa, synthetic construct
ESKYGPPCPSCP

SEQ ID NO: 27 - protein, 22 aa, synthetic construct
ESKYGPPCPPCPGGGSSGGGSG

SEQ ID NO: 28 - protein, 39 aa, synthetic construct
IEVMYPPPYLDNEKSNGTIIHVKGKHLCPSPLFPGPSKP

SEQ ID NO: 29 - protein, 48 aa, synthetic construct
AKPTTTPAPRPPTPAPTIASQPLSLRPEACRPAAGGAVHTRGLDFACD

SEQ ID NO: 30 - protein, 45 aa, synthetic construct
TTTPAPRPPTPAPTIASQPLSLRPEACRPAAGGAVHTRGLDFACD

SEQ ID NO: 31 - protein, 129 aa, synthetic construct
ESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 32 - protein, 229 aa, synthetic construct
ESKYGPPCPSCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 33 - protein, 229 aa, synthetic construct
ESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 34 - protein, 107 aa, synthetic construct
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 35 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 36 - protein, 41 aa, Homo sapiens
RSKRSRLLHSDYMNMTPRRPGPTRKHYQPYAPPRDFAAYRS

SEQ ID NO: 37 - protein, 41 aa, Homo sapiens
RSKRSRGGHSDYMNMTPRRPGPTRKHYQPYAPPRDFAAYRS

SEQ ID NO: 38 - protein, 42 aa, Homo sapiens
KRGRKKLLYIFKQPFMRPVQTTQEEDGCSCRFPEEEEGGCEL

SEQ ID NO: 39 - protein, 42 aa, Homo sapiens
ALYLLRRDQRLPPDAHKPPGGGSFRTPIQEEQADAHSTLAKI

SEQ ID NO: 40 - protein, 120 aa, Homo sapiens
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 41-48 - skipped (8 entries)

SEQ ID NO: 49 - protein, 652 aa, synthetic construct
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGGGSGGGSGGGGSSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 50 - protein, 112 aa, synthetic construct
RVKFSRSADAPAYQQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 51 - protein, 112 aa, synthetic construct
RVKFSRSADAPAYQQGQNQLYNELNLGRREEYDVLDKRRGRDPEMGGKPRRKNPQEGLFNELQKDKMAEAFSEIGMKGERRRGKGHDGLYQGLSTATKDTYDALHMQALPPR

SEQ ID NO: 52 - protein, 112 aa, synthetic construct
RVKFSRSADAPAYQQGQNQLYNELNLGRREEYDVLDKRRGRDPEMGGKPRRKNPQEGLYNELQKDKMAEAYSEIGMKGERRRGKGHDGLFQGLSTATKDTFDALHMQALPPR

SEQ ID NO: 53 - protein, 112 aa, synthetic construct
RVKFSRSADAPAYQQGQNQLYNELNLGRREEYDVLDKRRGRDPEMGGKPRRKNPQEGLYNELQKDKMAEAFSEIGMKGERRRGKGHDGLFQGLSTATKDTFDALHMQALPPR

SEQ ID NO: 54 - protein, 112 aa, synthetic construct
RVKFSRSADAPAYQQGQNQLYNELNLGRREEYDVLDKRRGRDPEMGGKPRRKNPQEGLFNELQKDKMAEAYSEIGMKGERRRGKGHDGLFQGLSTATKDTFDALHMQALPPR

SEQ ID NO: 55 - protein, 112 aa, synthetic construct
RVKFSRSADAPAYQQGQNQLYNELNLGRREEYDVLDKRRGRDPEMGGKPRRKNPQEGLFNELQKDKMAEAFSEIGMKGERRRGKGHDGLYQGLSTATKDTFDALHMQALPPR

SEQ ID NO: 56 - protein, 112 aa, synthetic construct
RVKFSRSADAPAYQQGQNQLYNELNLGRREEYDVLDKRRGRDPEMGGKPRRKNPQEGLFNELQKDKMAEAFSEIGMKGERRRGKGHDGLFQGLSTATKDTYDALHMQALPPR

SEQ ID NO: 57 - protein, 658 aa, synthetic construct
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGGGSGGGSGGGGSSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 58 - protein, 15 aa, synthetic construct
GGGGSGGGGSGGGGS

SEQ ID NO: 59 - protein, 10 aa, synthetic construct
GGGGSGGGGS

SEQ ID NO: 60 - protein, 242 aa, synthetic construct
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 61 - protein, 107 aa, synthetic construct [sequence omitted]

SEQ ID NO: 62 - protein, 120 aa, synthetic construct [sequence omitted]

SEQ ID NO: 63 - protein, 241 aa, synthetic construct
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGGGGSGGGGSGGGGSEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSS

SEQ ID NO: 64 - protein, 107 aa, synthetic construct [sequence omitted]

SEQ ID NO: 65 - protein, 119 aa, synthetic construct [sequence omitted]

SEQ ID NO: 66 - protein, 15 aa, synthetic construct
KASQSVDYDGDSYLN

SEQ ID NO: 67 - protein, 7 aa, synthetic construct
DASNLVS

SEQ ID NO: 68 - protein, 9 aa, synthetic construct
QQSTEDPWT

SEQ ID NO: 69 - protein, 111 aa, synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 70 - protein, 5 aa, synthetic construct
SYWMN

SEQ ID NO: 71 - protein, 17 aa, synthetic construct
QJWPGDGDTNYNGKFKG

SEQ ID NO: 72 - protein, 15 aa, synthetic construct
RETTTVGRYYYAMDY

SEQ ID NO: 73 - protein, 124 aa, synthetic construct
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 74 - protein, 16 aa, synthetic construct
RSSQSLLHKNAFNYLD

SEQ ID NO: 75 - protein, 7 aa, synthetic construct
LGSNRAS

SEQ ID NO: 76 - protein, 9 aa, synthetic construct
MQALQTPFT

SEQ ID NO: 77 - protein, 112 aa, synthetic construct
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIK

SEQ ID NO: 78 - protein, 5 aa, synthetic construct
SYGMH

SEQ ID NO: 79 - protein, 17 aa, synthetic construct
VISYEGSNKYYAESVKG

SEQ ID NO: 80 - protein, 13 aa, synthetic construct
DRGTIFGNYGLEV

SEQ ID NO: 81 - protein, 122 aa, synthetic construct
QVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSS

SEQ ID NO: 82 - protein, 11 aa, synthetic construct
RASQDVGTAVA

SEQ ID NO: 83 - protein, 7 aa, synthetic construct
WASTRHT

SEQ ID NO: 84 - protein, 10 aa, synthetic construct
QQYANFPLYT

SEQ ID NO: 85 - protein, 108 aa, synthetic construct
EIVMTQSPATLSVSPGERATLSCRASQDVGTAVAWYQQKPGQAPRLLIYWASTRHTGIPARFSGSGSGTEFTLTISSLQSEDFAVYFCQQYANFPLYTFGQGTKLEIK

SEQ ID NO: 86 - protein, 5 aa, synthetic construct
TYWIQ

SEQ ID NO: 87 - protein, 17 aa, synthetic construct
AVYPGDADTRYTQKFQG

SEQ ID NO: 88 - protein, 11 aa, synthetic construct
DAGLEYYALDY

SEQ ID NO: 89 - protein, 120 aa, synthetic construct
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSS

SEQ ID NO: 90 - protein, 10 aa, synthetic construct
RASSSVSYMN

SEQ ID NO: 91 - protein, 7 aa, synthetic construct
DTSKVAS

SEQ ID NO: 92 - protein, 9 aa, synthetic construct
QQWSSNPLT

SEQ ID NO: 93 - protein, 108 aa, synthetic construct
VDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 94 - protein, 5 aa, synthetic construct
RYTMH

SEQ ID NO: 95 - protein, 17 aa, synthetic construct
YINPSRGYTNYNQKFKD

SEQ ID NO: 96 - protein, 10 aa, synthetic construct
YYDDHYCLDY

SEQ ID NO: 97 - protein, 119 aa, synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 98 - protein, 14 aa, synthetic construct
RSSTGAVTTSNYAN

SEQ ID NO: 99 - protein, 7 aa, synthetic construct
GTNKRAP

SEQ ID NO: 100 - protein, 9 aa, synthetic construct
ALWYSNLWV

SEQ ID NO: 101 - protein, 215 aa, synthetic construct
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 102 - protein, 5 aa, synthetic construct
TYAMN

SEQ ID NO: 103 - protein, 19 aa, synthetic construct
RIRSKYNNYATYYAASVKG

SEQ ID NO: 104 - protein, 14 aa, synthetic construct
HGNFGNSYVSWFAY

SEQ ID NO: 105 - protein, 452 aa, synthetic construct
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCARHGNFGNSYVSWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 106 - protein, 14 aa, synthetic construct
RSSTGAVTTSNYAN

SEQ ID NO: 107 - protein, 7 aa, synthetic construct
GTNKRAP

SEQ ID NO: 108 - protein, 9 aa, synthetic construct
ALWYSNLWV

SEQ ID NO: 109 - protein, 109 aa, synthetic construct
QAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 110 - protein, 5 aa, synthetic construct
TYAMN

SEQ ID NO: 111 - protein, 19 aa, synthetic construct
RIRSKYNNYATYYADSVKD

SEQ ID NO: 112 - protein, 14 aa, synthetic construct
HGNFGNSYVSWFAY

SEQ ID NO: 113 - protein, 125 aa, synthetic construct
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSS

SEQ ID NO: 114 - protein, 254 aa, synthetic construct
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 115 - protein, 14 aa, synthetic construct
RSSTGAVTTSNYAN

SEQ ID NO: 116 - protein, 7 aa, synthetic construct
GTNKRAP

SEQ ID NO: 117 - protein, 9 aa, synthetic construct
ALWYSNLWV

SEQ ID NO: 118 - protein, 109 aa, synthetic construct
QTVVTQEPSLTVSPGGTVTLTCRSSTGAVTTSNYANWFQQKPGQAPRGLIGGTNKRAPGVPARFSGSLLGGKAALTLSGVQPEDEAEYYCALWYSNLWVFGGGTKVEIK

SEQ ID NO: 119 - protein, 5 aa, synthetic construct
TYAMN

SEQ ID NO: 120 - protein, 19 aa, synthetic construct
RIRSKYNNYATYYADSVKD

SEQ ID NO: 121 - protein, 14 aa, synthetic construct
HGNFGNSYVSWAAY

SEQ ID NO: 122 - protein, 125 aa, synthetic construct
QVQLVESGGGVVQPGRSLRLSCAASGFTFSTYAMNWVRQAPGKGLEWVARIRSKYNNYATYYADSVKDRFTISRDDSKNTLYLQMNSLRAEDTAVYYCARHGNFGNSYVSWAAYWGQGTLVTVSS

SEQ ID NO: 123 - protein, 14 aa, synthetic construct
GSSTGAVTSGNYPN

SEQ ID NO: 124 - protein, 7 aa, synthetic construct
GTKFLAP

SEQ ID NO: 125 - protein, 9 aa, synthetic construct
VLWYSNRWV

SEQ ID NO: 126 - protein, 109 aa, synthetic construct
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 127 - protein, 5 aa, synthetic construct
KYAMN

SEQ ID NO: 128 - protein, 19 aa, synthetic construct
RIRSKYNNYATYYADSVKD

SEQ ID NO: 129 - protein, 14 aa, synthetic construct
HGNFGNSYISYWAY

SEQ ID NO: 130 - protein, 125 aa, synthetic construct
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 131 - DNA, 276 bp, synthetic construct
  source 1..276: mol_type = other DNA
atgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaa

SEQ ID NO: 132 - DNA, 546 bp, synthetic construct
  source 1..546: mol_type = other DNA
atgatatcactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaa

SEQ ID NO: 133 - DNA, 174 bp, synthetic construct
  source 1..174: mol_type = other DNA
atgggtccatctatgagaaacccacaggatgtattcagtcagacaatgtctgacgtcggccacggtattcagggagtccttagtagcgtggcaatgacagggtctgaactgggcacaaggagaggccattgtaaaggtagacctgtagccgtttatgctaatagagggctttaa

SEQ ID NO: 134 - DNA, 141 bp, synthetic construct
  source 1..141: mol_type = other DNA
atgatgaaggcaatcattcctcataagatgataaaaagtgtagtgagagagcatgaaggagatttagtatttagcagtgcggatatgatccaagagggtgagatagtcgttctcgttcagaatctttcgcagcataagtag

SEQ ID NO: 135 - DNA, 984 bp, synthetic construct
  source 1..984: mol_type = other DNA
atgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagcatacagtaagcatagatacgtaaaatctcaaattgtgcatctactgatatccagctattcgaattcctctaacgaactcaagtcgaatataaatgatttcgatctgtattcgtatatgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcggattatctaaacaagcgatttagagtaaccccatataatgtagacatggaaatcgttaatcttcttattgagagacgtcatactcttgtcgacgtaatgcgtagtattacttcttag

SEQ ID NO: 136 - DNA, 165 bp, synthetic construct
  source 1..165: mol_type = other DNA
atgtggaaattaatctgtatcccgtcaacgacacatcgtgtactcggacgaccactaagaagtaatactacgcattacgtcgacaagagtatgacgtctctcaataagaagattaacgatttccatgtctacattatatggggttactctaaatcgcttgtttag

SEQ ID NO: 137 - DNA, 330 bp, synthetic construct
  source 1..330: mol_type = other DNA
atgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttga

SEQ ID NO: 138 - DNA, 234 bp, synthetic construct
  source 1..234: mol_type = other DNA
atggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataa

SEQ ID NO: 139 - DNA, 756 bp, synthetic construct
  source 1..756: mol_type = other DNA
atgtctcgcataaacattactaaaaaaatatattgttcggttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgtcgacgaggatggactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatag

SEQ ID NO: 140 - DNA, 240 bp, synthetic construct
  source 1..240: mol_type = other DNA
atgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaccgaacaatatatttttttagtaatgtttatgcgagacatataaaataa

SEQ ID NO: 141 - DNA, 423 bp, synthetic construct
  source 1..423: mol_type = other DNA
atgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataa

SEQ ID NO: 142 - DNA, 996 bp, synthetic construct
  source 1..996: mol_type = other DNA
atggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgatagtacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaaagaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtattcgactattatgttcttactggtgatacggaaccacccactgtattcattttcaaggtaactagattttactttaatatgccgaaataa

SEQ ID NO: 143 - DNA, 177 bp, synthetic construct
  source 1..177: mol_type = other DNA
atgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatag

SEQ ID NO: 144 - DNA, 198 bp, synthetic construct
  source 1..198: mol_type = other DNA
atgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaa

SEQ ID NO: 145 - DNA, 555 bp, synthetic construct
  source 1..555: mol_type = other DNA
atggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatag

SEQ ID NO: 146 - DNA, 189 bp, synthetic construct
  source 1..189: mol_type = other DNA
atgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaa

SEQ ID NO: 147 - DNA, 381 bp, synthetic construct
  source 1..381: mol_type = other DNA
atgagaatcctatttctcatcgctttcatgtatgggtgtgttcacccatatgttaatgccgacgaaatcaaatgtcctaacctaaacatcgtaacatcttctggagaatttcgttgcactggatgtgtgaaatttatgcctaattttagctacatgtattggttggcaaaggatatgagatcggacgaggatgctaaatttatagaacatttgggtgagggtatcaaggaggatgaaaccgttagtaccatagatggtagaatcgtcactctacagaaagtccttcatgtgactgatactaataaatttgataattataggttcacttgtgtcctcactacgatagatggcgtttcaaaaaagaatatttggctgaagtag

SEQ ID NO: 148 - DNA, 129 bp, synthetic construct
  source 1..129: mol_type = other DNA
atgttctataaatttagcatcctcgtccgatctcatatcctttgccaaccaatacatgtagctaaaattaggcataaatttcacacatccagtgcaacgaaattctccagaagatgttacgatgtttag

SEQ ID NO: 149 - DNA, 714 bp, synthetic construct
  source 1..714: mol_type = other DNA
atgtcttatgcttgcccaattcttagtactataaacatttgcctaccttatcttaaagacattaacatgattgacaaacgaggagaaacacttcttcacaaggctgttagatataataaacaatctctagtatctttactgctagaatccggttcagatgtcaacattagatcaaataacggatatacatgtatagccattgccatcaacgaatctagaaacattgaactgctgaaaatgctattatgtcataaacctacattagattgtgtgattgattcattgagagaaatatctaacatcgtagataactactatgctataaaacaatgtattaaatatgccatgattatagatgactgtacatcgtctaagattccagagtccataagtcaacgctataatgattatatagatctttgcaatcaagaattgaacgaaatgaaaaaaataatggtaggtggtaatactatgttctcattaatatttactgatcatggagctaaaattattcatagatatgccaataatccagaattacgtgagtattatgagttaaaacaaaataaaatatatgtggaagcatatgatattatttccgacgcaatagtgaaacatgatagaatacataaaaccatagaatcagttgatgataatacctacatttctaatcttccgtataccatcaaatacaaaatattcgagcaacaataa

SEQ ID NO: 150 - DNA, 414 bp, synthetic construct
  source 1..414: mol_type = other DNA
atgaaaggaatagataacactgcttattcatatatagacgatctaacatgttgcactcgagtaattatggctgattatctaaatagtgattatagatacaataaagatgtagatttagatttggtcaaattgtttttggaaaatggaaagccgcacggaataatgtgtagtattgtaccactatggagaaatgataaggaaaccatctttttgatattgaaaacaatgaactcggatgtcctccaacatatactaattgagtatatgacattcggcgatatccctctagtggaatatggaactgtggtaaataaagaggctatacacgaatactttagaaatattaatattgattcttacacgatgaaatatctactaaaaaaggaagggagatgccatcaattatctcgatga

SEQ ID NO: 151 - DNA, 159 bp, synthetic construct
  source 1..159: mol_type = other DNA
atggctgcagtgttctttatgaggacgagtactgatacgcgtatgatgattatcaactacgaaattgcggtaccgtattgcatctgtatatcatctctcatctgtattcaaagtcggatacgagagcatatgtgcgtccggaagttgttaaatgtctaa

SEQ ID NO: 152 - DNA, 234 bp, synthetic construct
  source 1..234: mol_type = other DNA
atgttaaagttaaaggatatagcgatggctctactagaagccactggatttagcaacataaatgactttaatatattcagctatatgaaatccaaaaatgtagacgttgacttgataaaggtgttggtagaacatggatttgacttgagtgttaaatgtgaaaaccatcgttcagttatagaaaattatgtaatgacaatgatcctgttcctaaaattattgatttgttcatag

SEQ ID NO: 153 - DNA, 216 bp, synthetic construct
  source 1..216: mol_type = other DNA
atgtttgactatctggaaaatgaggaggtggctctcgatgaacttaaacagatgttgagagacagagatcctaatgataccaggaaccaattcaagaataatgctttacacgcatacctttttaatgagcattgtaataatgtcgaggtcgtcaaactactactagacagtggcactaatccattacgcaaaaattggagacagctaccccattag

SEQ ID NO: 154 - DNA, 1905 bp, synthetic construct
  source 1..1905: mol_type = other DNA
atggttaacgataagatactctatgatagttgtaaaacatttaacatcgatgccagcagtgcacaatcattgatagaaagtggtgcaaatccattatatgagtatgatggtgaaactccattaaaggcatacgttaccaagaaaaataataatatcaaaaacgatgttgtgattttgttattgtcgtcagtcgactataaaaatatcaatgattttgatatattcgaatatctatgttctgataacatcgatatagacttattgaaattactaatttcgaaaggtatagaaataaatagtatcaaaaatggtattaatattgtagagaaatacgctacaacatcaaatcccaatgtagatgtgtttaaactattattggataaaggaatacctacatgtagcaacatacagtatggatacaagatcaaaatagaacagattagacgtgctggtgaatattataattgggatgatgaattagacgattacgattacgactacaccactgattatgatgatagaatgggtaaaacagttctctattattatattattactaggtcacaagatggttatgctacatctttggacgtgataaactatttaatttcacacaaaaaagagatgcgttattatacttatcgtgaacataccacactctattattatcttgacaaatgcgatattaaacgggaaatatttgacgcgttattcgatagtaactatagtggtcatgaactaatgaatattctatctaactatttacgtaaacagtttaggaagaaaaatcacaaaatcgataattatatagttgatcaactattattcgaccgtgatacgttttatattttagaattgtgtaatagtttacgtaataatatcctaatatccacaattcttaaaagatatacagattctatacaagatctattgttagaatatgtatcttatcatacagtatacatcaatgttattaaatgtatgattgatgaaggagctacattatatagatttaagcatataaataaatattttcaaaaatttggcaatagagatcctaaagttgtcgagtatattttaaaaaatggaaacttagttgtagataatgacaatgatgataacctaataaatattatgccattattccctaccttctctatgcgtgagttggatgtgttatcgatactaaaactttgtaagccgtatattgatgatataaacaaaatagataaacatggatgtagtatactttatcattgtattaagtcgcatagtgtcagcctagtagaatggttaatagataatggcgcagacattaatataataacaaaatatgggtttacatgtattactatttgtgttatactggcagataaatatatcccagaaatagcagaattatatattaagatattggaaattattctgagtaaattaccaaccatcgaatgtattaagaaaacagttgattacctagacgatcacaggtacttattcataggtggtaataataaatcgttactgaaaatatgtatcaagtacttcatattagtcgattataagtacacatgtagcatgtatccatcatatatagaatttataaccgactgcgaaaaagaaattgcggatatgcgtcaaattaaaataaatggtacggacatgcttacagtgatgtacatgttaaataaacctacaaagaaacgatatgttaataatccgatatttacagattgggctaataagcaatataagttttataatcaaataatatataatgctaataagttaatagaacaaagtaagaaaatagacgacatgatagaggaggtatccattgacgataatcgtttatcaacactaccgttagaaattagacatttgattttctcgtacgcgttcctataa

SEQ ID NO: 155 - DNA, 192 bp, synthetic construct
  source 1..192: mol_type = other DNA
atggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatga

SEQ ID NO: 156 - DNA, 213 bp, synthetic construct
  source 1..213: mol_type = other DNA
atgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatag

SEQ ID NO: 157 - DNA, 534 bp, synthetic construct
  source 1..534: mol_type = other DNA
atgtcttcgattagatttattgcatgtctatatctcatttccatcttcggaaattgtcatgaggatccatattatcaaccatttaataaattaaacattactctagatatatacacttatgaggatctagtaccatacaccgtagacaatgacacaacttctttcgttaagatatactttaaaaaattttggattactgttatgactaaatggtgtgctccgtttattgataccgttagcgtatacacatcgcatgataatctgaatatagaattttatactagagacgaatatgatacacaaagcgaggataaaatttgtaccattgatgttaaagcacgatgcaaccatctaacaaaaccagaagttacagtacaaaaagaagcgtacagatattcattatcttctgacctatcgtgttttgattctatagatctagacattgatctgatcgaaactaatagtactgacactacagtactgaaatcatatgagctcatgcttcccaaacgtgctaaatccatacataactga

SEQ ID NO: 158 - DNA, 249 bp, synthetic construct
  source 1..249: mol_type = other DNA
atggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataa

SEQ ID NO: 159 - DNA, 225 bp, synthetic construct
  source 1..225: mol_type = other DNA
atggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactag

SEQ ID NO: 160 - DNA, 453 bp, synthetic construct
  source 1..453: mol_type = other DNA
atgggtatacagcacgaattcgacatcattattaatggagatatcgcgttgagaaatttacagttacataaaggggataactacggatgcaaactaaaaattatttcgaatgattacaagaaattaaagtttagattcattatacgcccagattggtcggaaatcgacgaggtcaaaggattaaccgtatttgcaaacaactatgcggtgaaagttaataaggtagatgacacgttctattacgtaatatatgaggctgtaatacatctgtataacaaaaaaacagagatattgatttattctgatgatgagaacgaactctttaaacactattacccatacatcagtctaaatatgattagtaaaaagtataaagttaaagaagaaaactactcatccccgtatatagaacatccgttaatcccgtatagagattatgagtccatggattaa

SEQ ID NO: 161 - DNA, 456 bp, synthetic construct
  source 1..456: mol_type = other DNA
atgaatgcgtataataaagccgattcgttttctttagagtctgattctatcaaagatgttatacacgattatatttgttggctcagtatgactgatgaaatgagaccatctatcggaaacgtctttaaagcgatggaaacgtttaagatagacgcggttagatattacgatggtaacatatatgaattagctaaagatataaatgcgatgtcgtttgacggttttataagatctctacaaactatcgcttcaaagaaagataaactcactgtttatggaaccatgggactgctgtctattgtcgtagatattaacaaaggttgtgatatatccaatatcaagttcgctgccggaataatcattttaatggagtatatttttgatgacacggatatgtctcatcttaaagtagcactctatcgtagaatacagagacgtgatgatgtagatagataa

SEQ ID NO: 162 - DNA, 615 bp, synthetic construct
  source 1..615: mol_type = other DNA
atggcgtatatgaacagatcagatctcgataaactaaaacacgaaaatatcttttctgggaatattatagaggacgccaaagagttcgtctttggatctagaaaaatatatactgattctgttgatgatctaatagaattatatagtttagccaaatatcttaacaacgaaaatcttaaagatgtagtgattgagagaatggattatgtgtgcaaatatatcggtaaagataattggagtactatatattcgttttataaagaaaatggtctacgtaatagttttctacgacaatacatcaacaataatatagaagagatatgtaacacagaccaatttctaaaattggatgtagattcagtatgtgatattctagacaacgatgagatcgtagtaactagagaatatactatcttaaacatggtattacgatggctagaaaataaaagagttaatatagacgactttactaaagtcatgttcgttattcgatttaaatttataacatattctgaacttactaatgcgataaagaaaatagctccagaatacagacaatgcttacaggatctataccatatgaaaattacgcgtcctagacactttgataactag

SEQ ID NO: 163 - DNA, 951 bp, synthetic construct
  source 1..951: mol_type = other DNA
atggatactattaaaatatttaatcatggagagtttgatactattagaaatgaattggtcaacttgttaaaagttgtaaaatggaacaccattaattcaaatgtaacggtatcgtctaccgacacaatagatatatctgattgtatcagagagatattatacaaacagtttaaaaatgtacgaaatatagaggtgagcagtgatatatctttcataaaatataatagatttaatgatactactctaacagatgataatgtgggatattatttagtgatttatttgaatcggacgaaatctgtaaagactttaatatatcctactccagaaacagtgataacatcatccgaggatataatgttttctaaatctcttaactttagattcgagaatgtaaagcgcgactataaattggttatgtgttctatatctttgacatacaagccatctatatgcagaatccaatacgataacaataaatatttagatattagcgacagtcaagaatgtaataatctatgttactgcgtcataactatggatccccaccacttgatagatttagaaaccatatgtgtcttggtcgataaatcaggaaagtgtttgctagtaaacgagttttatattagatttaggaaaaatcacatctacaatagctttgccgatctatgcatggatcatatatttgaactaccgaatacaaaagaattattcactctgcgcaacgatgatggacgaaacatagcctgggataatgataagttggaaagtggtaataatacatggattcctaaaacagatgatgagtataagtttctatctaaattgatgaatattgcgaagtttaacaacaccaaatttgattactacgtgcttgttggagatacggatccgtgtactgtctttacgttcaaagtaacaaagtattacatcaatctcaattatgaatag

SEQ ID NO: 164 - DNA, 192 bp, synthetic construct
  source 1..192: mol_type = other DNA
atgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatga

SEQ ID NO: 165 - DNA, 786 bp, synthetic construct
  source 1..786: mol_type = other DNA
atgaaggtggagagcgtgacgttcctgacattgttgggaataggatgcgttctatcatactgtcctattccttcacgtcccattaatataaaatttaagaatagtgtggaaactaatgctaattacaacataggagacactatagaatatctatgtctacctggatacagaaagcaaaaaatgggacctatatatgctaaatgtacaggtactggatggacactctttaatcaatgtattaaacggagatgcccatcgcctcgagatatcgataatggccaacttgatattggcggagtagactttggctctagtataacgtactcttgtaatagcggatatcagttgatcggtgaatctaaatcgtattgtgaattaggatctactggatctatggtatggaatcccgaggcacctatttgtgaatctgttaaatgccaatcccctccatctatatccaacggaagacataacggatacgaggatttttataccgatgggagcgttgtaacttatagttgcaatagtggatattcgttgattggtaactctggtgtcctgtgttcaggaggagaatggtccgatccacccacgtgtcagattgttaaatgtccacatcctacaatatcaaacggatacttgtctagcgggtttaaaagatcatactcatacaacgacaatgtagactttaagtgcaagtacggatataaactatctggttcctcatcatctacttgctctccaggaaatacatggaagccggaacttccaaaatgtgtacgctaa

SEQ ID NO: 166 - DNA, 144 bp, synthetic construct
  source 1..144: mol_type = other DNA
atgggcttttttattatttgtacgatgtccaggataacatttttacggataaataaatatgaaggtggagagcgtgacgttcctgacattgttgggaataggatgcgttctatcatactgtcctattccttcacgtcccattaa

SEQ ID NO: 167 - DNA, 180 bp, synthetic construct
  source 1..180: mol_type = other DNA
atgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatga

SEQ ID NO: 168 - DNA, 1521 bp, synthetic construct
  source 1..1521: mol_type = other DNA
atggaaagcgtgatattttctatcaatggggaaattatacaagtgaataaggaaattattacggcgtctccgtataatttttttaaacgcattcaggagcaccatataaatgatgaagtgattatattgaatggtataaactatcacgcgtttgaatcgctattagactatatgcgctggaagaagataaacatcaccataaacaatgtagaaatgatactagttgctgccgtaataattgatgttacgcctgtagtagatctatgtgtaaaaactatgattcataatattaattccacaaattgtataaggatgtttaacttttctaaacaatatggaattaaaaaactatataatgcgtcgatgttagaaataatcaacaatattactgcggtgacatccgatccagaatttggaaaattatcaaaggatgaactgacaactatcttatcccacgaagacgttaacgtaaatcatgaggatgttacagctatgatattattaaagtggatacataaaaatccaaacgatgtagatatcatcaacattttacatcccaagtttatgactaatactatgcgcaatgctatatcattgttgggattaactatatccaaatctacaaagccagtgacacgaaatggtataaaacataatatagtagtcattaaaaactctgattatatatccacaataacccattactctcctagaacagaatattggacgatagtcggtaatacagatagacaattctataatgcaaatgttttacataattgtctatacattattggcggcatgattaacaatagacatgtttattccgtatcgcgggtagatcttaaaacgaaaaaatggaaaacggttactaatatgtcgtcgttaaaatcagaagttagtacttgtgttaacgatggaaagttatatgtaataggaggattagaattttctatttcaacgggtgtggcagaatatttgaaacacggcacttcgaaatggataagacttccaaacttaattactcctagatattcaggcgcgtcggtattcgtaaacgatgatatatatgtaatgggtggagtttataccacgtatgagaaatatgtagtattaaacgatgtagaatgtttcactaaaaatcgttggataaaaaagtctcccatgcctagacatcatagtatagtttatgctgtagagtacgatggtgacatctatgcaattactggaattacttatgagactcgtaattatctatacaaatatatagttaaggaagacaaatggatagaattatacatgtactttaaccatgtaggaaagatgttcgtgtgttcttgcggtgattatatcttaattatagcagatgcaaaatacgaatattatccaaaatcaaatacttggaatttgttcgatatgtcaactcgtaatatcgaatattatgatatgtttactaaagatgaaactcataagtcactgccatcgtttttgagcaactgtgaaaaacaatttctacaatag

SEQ ID NO: 169 - DNA, 195 bp, synthetic construct
  source 1..195: mol_type = other DNA
atgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatga

SEQ ID NO: 170 - DNA, 675 bp, synthetic construct
  source 1..675: mol_type = other DNA
atggtgaaaaataataaaataagtaatagctgccgaatgataatgagtactaaccctaataatattttaatgagacatctcaaaaatcttacagatgatgaatttaaatgtattattcatcgatcatctgattttctttatttgtctgatcgtgactatactagtataaccaaagaaacattagttagtgagatcgtagaagaatatccggatgattgtaataaaatattagctattatatttttggtgttagataaagacatagatgtagatataaaaactaaactaaagcctaaacccgcagttagatttgccattctagacaagatgactgaggatattaaactaacggatctagtcagacattattttagatacatagaacaagatataccactaggtccgttgttcaaaaaaatagattcgtacagaacaagagccattaataagtattcgaaagagttaggattggctactgaatactttaataagtacgggcatttaatgttttatactctccctataccatataatagattcttttgtagaaattcgataggctttttagcggttctatcgcctacgataggacacgtaaaagcattttataaattcatagaatacgtttctatagatgatagacggaaatttaaaaaggaattaatgtcaaaatga

SEQ ID NO: 171 - DNA, 354 bp, synthetic construct
  source 1..354: mol_type = other DNA
atgaggactctacttattagatatattctttggagaaatgacaacgatcaaacctattataatgatgattttaaaaagcttatgttgttggatgaattggtagatgacggcgatgtatgtacattgattaagaacatgagaatgacgctgtccgacggtccattgctagatagattgaatcaaccagttaataatatagaagacgctaagcgaatgatcgctattagtgccaaagtggctagagacattggtgaacgttcagaaattagatgggaagagtcattcaccatactctttaggatgattgaaacatattttgatgatctaatgattgatctatatggtgaaaaataa

SEQ ID NO: 172 - DNA, 528 bp, synthetic construct
  source 1..528: mol_type = other DNA
atgacgtcctctgcaatggataataatgaacctaaagtactagaaatggtatatgatgctacaattttacccgaaggtagtagcatggatccaaatatcatggattgtataaacagacacatcaatatgtgtatacaacgcacctatagttctagtataattgccattttggatagattcctaatgatgaacaaggatgaactaaataatacacagtgtcatataattaaagaatttatgacatacgaacaaatggcgattgaccattatggaggatatgtgaacgctattctatatcaaattcgtaaaagacctaatcaacatcacaccattgatctgtttaaaagaataaaaagaacccggtatgacacttttaaagtggatcccgtagaattcgtaaaaaaagttatcggatttgtatctatcttgaacaaatataaaccggtttatagttacgtcctgtacgagaacgtcctgtacgatgagttcaaatgtttcattgactacgtggaaactaagtatttctaa

SEQ ID NO: 173 - DNA, 1419 bp, synthetic construct
  source 1..1419: mol_type = other DNA
atgatatttgttatagagagtaaattgttgcaaatatacagaaatagaaatagaaatattaatttttatactacaatggacaacattatgtcggccgagtattatctatctctttatgccaaatataatagtaaaaatttagatgtatttaggaatatgctacaagctatcgaaccttctggaaataattatcacattctacatgcgtattgtggaattaaaggactagatgaacgatttgtcgaagaacttcttcatagaggatactctccaaatgagacggatgatgatggaaattatccattgcatatagcttctaaaattaataataatagaatagtcgcgatgctgctgacgcacggcgcagatccaaacgcgtgtgataaacataataaaacacctctatattatctctcgggaacagatgatgaagtcatagagagaataaatttattggtacagtatggagccaagattaacaactcggttgatgaagaaggatgtggtccgttgttggcgtgtacagatccttcagaaagagtgtttaaaaaaataatgtccatcggattcgaagccaggatagtggataaatttggcaaaaatcatattcatagacatcttatgtcagacaatccaaaagcttctacaatctcatggatgatgaaactaggaattagtccctcaaaaccagatcatgatggaaatacacctctccatattgtatgctctaaaacagtcaagaatgtagacattatagatcttttacttccatcaacggatgttaataaacaaaacaaattcggagatagtcctcttacacttcttattaagacattgagcccagcgcatcttattaacaaattgctatcgactagcaatgttattacggatcaaacagttaatatttgtatcttttatgatagagatgatgttttagaaattattaatgataaaggaaagcaatatgattttaccgattttaagatggctgttgaagtgggatccataagatgcgtcaaatatctattagacaatgatataatttgtgaagatgccatgtactacgctgtactatctgaatacgaaacaatggtagactatctattgttcaatcattttagtgtagactctgtagttaacggtcatacatgtatgagcgaatgtgtaagactaaataacccagtcattttatcgaagctgatgttacataatcctacttctgagaccatgtatctaactatgaaagctatagaaaaagatagactagataaatctattattattccgtttatcgcgtactttgtacttatgcatccggacttttgtaaaaatcgtagatactttacttcatataaacgttttgtaactgattatgttcatgaaggagtatcttacgaagtattcgatgattatttttaa

SEQ ID NO: 174 - DNA, 156 bp, synthetic construct
  source 1..156: mol_type = other DNA
atggacattatttttttaaacactctttctgaaggatctgtacacgccaacaacggaccacatccttcttcatcaaccgagttgttaatcttggctccatactgtaccaataaatttattctctctatgacttcatcatctgttcccgagagataa

SEQ ID NO: 175 - DNA, 663 bp, synthetic construct
  source 1..663: mol_type = other DNA
atggtttacaaattagtcttactcttttgtatcgcatctctcgggtattcagtagaatacaagaatactatatgtcctcctcgacaagattaccggtattggtactttgccgccgaactcactattggtgtaaattacgacattaattctactattattggtgagtgtcatatgagtgaaagctatatcgacagaaatgctaacatagtgttgactggatacggactagaaataaacatgaccatcatggatacggatcagagatttgtggcagcggctgagggtgttggtaaagataataaactatctgttctgttgtttaccactcagcggctagataaagttcatcataatattagtgtgacaataacatgtatggaaatgaattgtggaaccacaaaatacgatagcgatcttccggaatcaattcataaatcatcatcgtgtgatataactataaatggatcatgtgtgacatgtgttaacttagagactgatccaacaaagattaatccccattacctacaccccaaggataaatatctttatcataattctgagtatggcatgcgtggtagttatggcgtgacatttatagatgaactaaaccagtgccttcttgacataaaagaactaagttatgatatttgttatagagagtaa

SEQ ID NO: 176 - DNA, 855 bp, synthetic construct
  source 1..855: mol_type = other DNA
atggatctgtcacgaattaatacttggaagtctaagcagctgaaaagctttctctctagcaaagatgcatttaaggcggatgtccatggacatagtgccttgtattatgcaatagctgataataacgtgcgtctagtatgtacgttgttgaacgctggagcattgaaaaatcttctagagaatgaatttccattacatcaggcagccacattggaagataccaaaatagtaaagattttgctattcagtggactggatgattcacaatttgatgacaagggaaacaccgcattgtattatgcggttgatagtggtaacatgcaaacggtaaaactgtttgttaagaaaaattggagactgatgttctatgggaaaactggatggaaaacttcattttatcatgccgtcatgcttaatgatgtaagtattgtttcctactttctttcagagataccatctacttttgatctggctattctccttagttgtattcacaccactataaaaaatggacacgtggatatgatgattctcttgctcgactatatgacgtcgacaaacaccaataattcccttctcttcattccggacattaaattggctatagataataaagacattgagatgttacaggctctgttcaaatacgacattaatatctattctgctaatctggaaaatgtactattggatgatgccgaaatagctaaaatgattatagaaaagcatgttgaatacaagtctgactcctatacaaaagatctcgatatagtcaagaataataaattggatgaaataattagcaaaaacaaggaactcagactcatgtacgtcaattgtgtaaagaaaaactaa

SEQ ID NO: 177 - DNA, 1110 bp, synthetic construct
  source 1..1110: mol_type = other DNA
atgattgcgttattgatactatcgttaacgtgttcagtgtctacctatcgtctgcaaggatttaccaatgccggtatagtagcgtataaaaatattcaagatgataatattgtcttctcaccgtttggttattcgttttctatgtttatgtcgctattgcctgcatcaggtaatactagaatagaattattgaagactatggatttgagaaaaagagatctgggtccagcatttacagaattaatatcaggattagctaagctgaaaacatctaaatatacgtacactgatctaacttatcaaagtttcgtagataatactgtgtgcattaaaccgtcgtattatcaacaatatcatagattcggcctatatagattaaactttagacgagatgcggttaataaaattaattctatagtagaacgtagatccggtatgtctaatgtagtagattctaatatgctcgacaataatactctatgggcaatcattaatactatatattttaaaggtatatggcaatatccgtttgatatcactaaaacacgcaatgctagttttactaataagtacggtacgaaaacggttcccatgatgaacgtagttactaaattgcaaggaaatacaatcacaatcgatgacgaagaatatgatatggtacgccttccgtataaggatgctaatattagtatgtacctggcaataggtgataatatgacccatttcacagattctattacggctgcaaaattagactattggtcgtttcaattagggaataaagtgtacaatcttaaactccctaaattttctatcgaaaataagagggatattaagtcgatagccgaaatgatggctcctagtatgtttaatccagataatgcgttgtttaaacatatgactagggacccattatatatttataaaatgtttcagaatgcaaagatagatgtcgacgaacaaggaactgtagcagaggcatctactatcatggtagctacggcgagatcatctcctgaaaaactggaatttaatacaccatttgtgttcatcatcagacatgatattactggatttatattgtttatgggtaaggtggaatctccttaa

SEQ ID NO: 178 - DNA, 246 bp, synthetic construct
  source 1..246: mol_type = other DNA
atgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatag

SEQ ID NO: 179 - DNA, 240 bp, synthetic construct
  source 1..240: mol_type = other DNA
atgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatga

SEQ ID NO: 180 - DNA, 267 bp, synthetic construct
  source 1..267: mol_type = other DNA
atgcttgcattttgttattcgttgcccaatgcgggtgatgtaataaagggcagagtatacgagaatgattatgctctatatatttatctttttgactatcctcactttgaagctatcttggcagagagtgttaagatgcatatggatagatatgttgaatatagggataaactggtagggaaaactgtaaaagttaaagtgattagagttgattatacaaaaggatatatagatgtcaattacaaaaggatgtgtagacatcaataa

SEQ ID NO: 181 - DNA, 186 bp, synthetic construct
  source 1..186: mol_type = other DNA
atgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatag

SEQ ID NO: 182 - DNA, 1275 bp, synthetic construct
  source 1..1275: mol_type = other DNA
atgaatccggataatacaatcgcagtgattacagagactattcctataggtatgcaatttgataaagtatatttgtctacatttaacatgtggagggaaattctatccaataccacaaaaacactagatatatcatctttttattggagtttatcggatgaagtgggtacgaatttcggcacgataatattaaacgagattgtacaattacccaaaagaggagtaagagttagagtagccgtcaataaatctaacaaaccattaaaggatgttgaaagactacaaatggccggagttgaagtacgatacatagatattacaaatatcctaggaggagttcttcatacaaaattttggatatctgataatacacatatttatttaggaagcgctaacatggattggagatcactaactcaggtcaaagaattgggtattgcgatcttcaataataggaacttggcagcggatctcactcaaatttttgaggtatactggtatcttggagttaacaatctaccatataattggaaaaacttttatccgtcgtattataatacagatcatcctcttagtattaacgtaagtggtgttccacactctgtatttattgcttctgcaccgcaacaactatgtactatggaaagaaccaatgatttaaccgctttattgtcatgtattagaaatgcgagtaaattcgtttatgtatctgttatgaactttatccctattatttattcgaaggcaggcaatattttgttttggccttatatagaagatgaattaagaagagccgctatagacagacaagtatccgttaagctattgattagttgctggcaacgatcttcgtttatcatgagaaactttttaagatctatcgctatgctaaaatctaaaaacataaatatagaagtaaagctatttattgtaccagatgctgatcctcccattccgtattctagggtaaaccatgccaaatatatggtaaccgataaaacggcgtatataggtacctcaaattggacaggaaattactttacggatacatgtggagcatctattaatattacaccggatgatggattaggtcttcgtcaacaattggaagatatttttatgcgtgattggaattcaaaatacagctatgaattgtacgatactagtcctactaaaaggtgtagactattaaaaaatatgaaacaatgtacaaatgatatatactgcgatgagatacaaccggaaaaagaaattcctgaatattctcttgaataa

SEQ ID NO: 183 - DNA, 186 bp, synthetic construct
  source 1..186: mol_type = other DNA
atgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggctcttcttaattcatcttctatataa

SEQ ID NO: 184 - DNA, 171 bp, synthetic construct
  source 1..171: mol_type = other DNA
atgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataa

SEQ ID NO: 185 - DNA, 366 bp, synthetic construct
  source 1..366: mol_type = other DNA
atgggagcaacaatttctatactagcctcttacgataatccaaacttgtttacagcaatgattctaatgtctcctctagttaatgcagatgctgtttcaaaactgaatctgctagctgccaaacttatgggaaccatcacaccaaatgcgccagtcggaaagctatgtccagaatcagtatctagagatatggataaagtttataaataccaatacgacccattaatcaatcatgaaaaaattaaggctggatttgctagtcaggtcttgaaggctaccaacaaggttagaaaaataattcccaagattaacaccccccgactctcatactccagggaacaaacaatgagattagcgatgttttag

SEQ ID NO: 186 - DNA, 333 bp, synthetic construct
  source 1..333: mol_type = other DNA
atgagtgcaaactgtatgttcaatctggacaatgattacatatattggaaacctattacatatcctaaggcattagtattcataagtcatggagctggtaaacattctggacgttatgacgaactagctgaaaacatatcatcgttaggaattttagtattctcacatgatcatattggacatggaagaagtaatggtgaaaaaatgatgattgatgactttggtacgtatgttagagatgtggtacagcacgtggtaactattaaatctacttatttaggagttccagtcttcttattgggcattccatgggagcaacaatttctatactag

SEQ ID NO: 187 - DNA, 450 bp, synthetic construct
  source 1..450: mol_type = other DNA
atggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattga

SEQ ID NO: 188 - DNA, 195 bp, synthetic construct
  source 1..195: mol_type = other DNA
atggacttttgtaaaattgatgtagtggtctccttcgctcatagcttcgacaatctcattaattttatcaataccatagtaccgtatagcgacatcatcgaacttcatcaattccttgtacagtcttccacaactggtaatatctttgttaaacactataacatgatttctccacgtaatatattcatctattag

SEQ ID NO: 189 - DNA, 681 bp, synthetic construct
  source 1..681: mol_type = other DNA
atgttgtcgatgtttatgtgtaataatatcgtagattatgtagatgatatagataatggtatagtacatgatatagaagatgaggctagcaataatgttgatcacgactatgtatatccacttccagaaaatatggtatatagatttgacaagtccactaacatactcgattatctatcaacggaacgggaccatgtaatgatggctgttcgatactatatgagtaaacaacgtttagacgacttgtatagacagttgcccacaaagactagatcatatatagatattatcaacatatattgtgataaagttagtaatgattataatagggacatgaatatcatgtatgatatggcatctacaaaatcatttacagtttatgacataaataacgaagttaatactatactaatggataacaaggggttgggtgtaagattggcgacaatttcatttataaccaaattgggtagacgatgtatgaatccagtaaaaactataaaaatgtttactctactatcgcatactatatgcgatgattgttttgtagattatataacggacatttcaccaccagataataccatccctaacactagcacgcgtgaatatctaaagcttattggcatcacagctatcatgtttgctacatataaaactctcaaatacatgataggataa

SEQ ID NO: 190 - DNA, 444 bp, synthetic construct
  source 1..444: mol_type = other DNA
atgttcaacatgaatattaactcaccagttagatttgttaaggaaactaacagagctaaatctcctactaggcaatcgccgggtgctgccggatatgatttgtatagcgcttacgattatactatccctccaggagaaagacagttaattaagacagatattagtatgtccatgcctaagatttgctatggtagaatagctcctaggtctggtctgtcactaaaaggcattgatataggaggtggtgtaatagacgaagattataggggaaacataggagtcattcttattaataatggaaaatgtacgtttaatgtaaatactggagatagaatagctcagctaatctatcaacgtatatattatccagaactggaagaagtacaatctctagatagtacaaatagaggagatcaagggtttggatcaacaggacttagataa

SEQ ID NO: 191 - DNA, 1443 bp, synthetic construct
  source 1..1443: mol_type = other DNA
atgccgatatttgttaatactgtgtactgtaagaatatattagcattgtctatgactaagaaattcaaaacaattattgatgctataggtggcaatataatagtcaattctacgatattgaaaaagttatctccttactttcgcacacatttacgtcaaaaatacacgaaaaataaagatccagttacgagggtttgtctagaccttgacattcacagtttaacttctatagttatttactcgtatactggaaaggtatatatagatagtcataacgtcgtcaatttattacgtgcttctatattaacctctgtagaatttatcatctacacttgtataaactttatcttacgagattttagaaaggaatattgtgtcgagtgttacatgatgggtatagaatacggactatccaatctcttatgtcatactaaaaactttattgccaaacactttttggaactggaagatgacatcatagacaattttgattatctatctatgaaacttattctagaaagcgatgaactaaatgttccagatgaggattatgtagttgattttgtcattaagtggtatataaagcgaagaaataaattaggaaatctgctactccttatcaaaaatgtaatcaggtcaaattatctttctcccagaggtataaataatgtaaaatggatactagactgtaccaaaatatttcattgtgataaacaaccacgcaaatcatacaagtatccattcatagagtatcctatgaacatggatcaaattatagatatattccatatgtgtacaagtactcatgttggagaagtagtatatctcatcggtggatggatgaacaatgaaatacataacaatgctatagctgtaaattatatatcaaacaattggattccaattcctccgatgaatagccccagactgtatgctagcgggatacccgctaacaataaattatacgtagtaggaggtctaccaaatcccacatctgttgagcgttggttccacggggatgctgcttgggttaatatgccgagtcttctgaaacctagatgtaatccagcagtggcatctataaacaatgttatatacgtaatgggaggacattctgaaactgatacaactacagaatatttgctacccaatcatgatcagtggcagtttggaccatccacttattatcctcattataaatcatgcgcgttagtgttcggtagaaggttattcttggttggtagaaatgcggaattttattgtgaatccagcaatacatggactctgatagatgatcctatttatccgagggataatccagaattgatcatagtggataataaactgctattgataggaggattttatcgtgaatcgtatatagatactatagaagtgtacaatcatcacacttattcatggaatatatgggatggtaaataa

SEQ ID NO: 192 - DNA, 960 bp, synthetic construct
  source 1..960: mol_type = other DNA
atggaacccatccttgcaccaaatccaaatagatttgttattttcccaatccaatattatgacatctggaacatgtataaaaaggcagaggcatcattttggacagtggaagaagtagatatatctaaagatatcaatgattggaataaactaacaccagacgaaaaatattttataaaacatgtattggcgttttttgcagccagtgacggaatagtgaatgaaaatttggcggaacgattttgtacagaagtacagattaccgaggctagatgtttctacggatttcagatggccattgaaaacattcattcggaaatgtatagtcttttgatcgatacttatgttaaagatagtaatgaaaaaaactatctctttaatgccatagaaacgatgccttgtgtaaaaaagaaggccgattgggctcaaaagtggatacatgacagcgccggttatggagagagacttattgcctttgctgcagtagaaggaatcttcttttccggatcattcgcttccatattttggcttaaaaagcgtggcctaatgcccggactcacgttttccaacgaactaattagtagagacgagggtctacactgcgacttcgcatgtttgatgtttaaacatttattgtatccaccgagtgaagaaaccgttagatctattataacagatgcagtatccattgaacaagaatttcttactgcggctcttccagttaaacttataggaatgaattgtgaaatgatgaaaacatatatagaattcgtcgcggatagattgatttctgaattgggatttaaaaaaatttataatgttaccaatccgtttgatttcatggaaaatatatcattggaaggaaaaactaattttttcgaaaaacgtgtgggtgaataccaaaaaatgggagttatgtctcaaaaagataatcatttttctctagatgttgacttttaa

SEQ ID NO: 193 - DNA, 237 bp, synthetic construct
  source 1..237: mol_type = other DNA
atggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccggaaaagaagattccttctactgcagcaaaggcaataagtctctctccataa

SEQ ID NO: 194 - DNA, 291 bp, synthetic construct
  source 1..291: mol_type = other DNA
atgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttag

SEQ ID NO: 195 - DNA, 966 bp, synthetic construct
  source 1..966: mol_type = other DNA
atgggtacgaacggcgttagagtatttgtcattttatatttgttggctgtatgcggatgtatcgaatacgacgtagacgataatgtacatatttgtacccacactaacgtgtcacatattaatcacactagttggtattataatgataaggttatagcgctagccaccgaggataaaacttctggttatatatcatcattcataaaacgcgttaatatctcattaacttgtttaaatatatcgagtttgaggtacgaagattctggtacatacaaaggagtatcgcatctaaaagatggagtcatcgttacgactactatgaatatatctgtaaaggctaatatcattgacttgactggtagagtgcgttatctaaccagaaattattgcgaagttaaaatacgatgcgaaataacatctttcgcgcttaatggttctactacaccaccacatatgatattaggaacagtagataaatggaaatatcttccatttcctacagatgattatagatacgtaggggaactgaaaagatatatatctggaaacccatatccaacagagtcgctagcgttagaaattagctcgacgtttaatcggtttactatcgttaaaaatttgaacgataacgagttttcttgttatctgttttcacaaaattatagtttccataaaatgttgaatgtgcgtaacatttgtgaatccaaatggaaggcgttaaataataatgataatgcatcctccatgcccgcttcccacaacaatctcgcaaacgatttatttagtatgatgtcacaattacaaaatgataatgatgataataacgattattcagcacccatgaatgtcgataatttaattatgatagtactaataacaatgctatcaataatacttgtaattattgtagtgattgcggcgatatcgatgtacaaaaaatccaagtacaggcatatagataactga

SEQ ID NO: 196 - DNA, 162 bp, synthetic construct
  source 1..162: mol_type = other DNA
atgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataa

SEQ ID NO: 197 - DNA, 225 bp, synthetic construct
  source 1..225: mol_type = other DNA
atgagtaaaatactcacgtttgttaaaaataagataattgacttgattaataatgaccaaattaaatattctagagttataatgatagaagagtccgatagtcttttaccggttgatgaggtgcatgctaaccacggatttgactgtgtggagatgatagatgaaaatataagcaatgagaatatcgaacagtataaaaccgaatctttttttacaataaattga

SEQ ID NO: 198 - DNA, 243 bp, synthetic construct
  source 1..243: mol_type = other DNA
atgacgctcgtcatgggatcctgctgtggtagattctgtgacgctaagaataagaataagaaggaagatgtagaagagggaagagaaggatgttacaattataagaaccttaatgatctggatgaatccgaagcacgtgtagaatttggaccattatatatgataaatgaagaaaaatcagacataaatacattggatataaaaagaagatatagacacacgatagagtctgtatatttctaa

SEQ ID NO: 199 - DNA, 198 bp, synthetic construct
  source 1..198: mol_type = other DNA
atggagggatctaaacgcaaacacgacagtcggcgactacaacaagaacaggagcagcctcgtccacgtacaccgccatcatatgaagaaattgcaaaatatggacactcatttaacgtgaaaagatttacgaataaagaaatgtgtcttaaaaatgattatccacgaattatatcatataatcctccaccaaaatag

SEQ ID NO: 200 - DNA, 639 bp, synthetic construct
  source 1..639: mol_type = other DNA
atggcggaaactaaagagtttaaaactttgtataatctttttatagatagttatttacaaaaattagctcaacattctatccctactaatgtcacttgtgctattcatataggagaggttataggacagtttaaaaattgcgcgctccgaataactaacaaatgcatgagtaattctcgacttagtttcacactcatggttgaatcatttattgaagtgatttcattgcttccggaaaaggatagaagagctatcgctgaagaaataggaatagatctagacgatgtacctagtgcggtatccaagctagaaaagaactgtaatgcgtatgcggaggttaataatattatagatatacagaaattagatatcggagaatgttcggctccgcccggtcaacatatgcttttacagatagttaatacaggatccgcggaagcaaattgtggtttacagacaattgttaagtccttaaataaaatatacgttccacctattatcgaaaaccgattgccgtattacgatccgtggtttctagtgggtgtagcaattattctagttatttttactgtagctatttgttctattagacgaaatctggctcttaaatacagatacggaacgtttttatacgtttaa

SEQ ID NO: 201 - DNA, 1320 bp, synthetic construct
  source 1..1320: mol_type = other DNA
atgggtgttgccaatgattcatcccctgaatatcaatggatgtctccccatagattatcagatactgttatattaggagactgtttgtattttaacaatataatgtcccaattagatttacaccaaaattgggctccgtcagttagattgttaaattattttaagaattttaatagggaaacactactaaagatagaagagaatgattacattaattcatcctttttccaacaaaaggataaacgattttatcctataaacgacgatttttatcacatatctacaggaggatatggtatagtctttaagatagataactatgtagtaaaatttgtattcgaggccacaaaattatatagtcccatggaaactacggcggagttcacagtacccaaatttctatacaacaatctaaagggagatgaaaaaaaattaatcgtgtgtgcgtgggccatgggattaaactataaattaacatttttacatactctgtataaacgggttcttcatatgttgctattattgatacaaactatggatggtcaggaactctcattgagatattcttctaaagtttttttaaaggcgtttaacgagagaaaggacagtatcaaattcgtgaaattactatcccacttttacccggcagttattaacagtaatattaatgttataaactattttaaccgcatgtttcactttttcgaacatgaaaagagaactaactacgaatacgaaagaggaaatattataatttttcccctagcactgtattctgcagataaagtagataccgagttagctatcaaattaggatttaaatctttggtacaatacataaagtttatctttttacagatggctctgttatacattaaaatttacgaactaccatgctgcgacaactttttacacgcagatcttaaacccgataatatcttactttttgattccaatgaaccaataataattcatctaaaggataaaaagtttgtttttaatgaacgtattaaatcggcattaaacgactttgacttttcccaagtggctggaatcattaacaagaaaataaaaaacaatttcaaagttaaacataactggtattacgatttccatttctttgttcatactttattaaaaacatatccagaaatcgaaaaagatatcgaatttagtacagcattagaagaattcatcatgtgtaccaagacagactgtgataaatatagattaaaggtttccattcttcacccaattagtttcttggaaaaatttattatgagagacattttctcagactggataaatggcggaaactaa

SEQ ID NO: 202 - DNA, 150 bp, synthetic construct
  source 1..150: mol_type = other DNA
atgtataacagagccatctgtaaaaagataaactttatgtattgtaccaaagatttaaatcctaatttgatagctaactcggtatctactttatctgcagaatacagtgctaggggaaaaattataatatttcctctttcgtattcgtag

SEQ ID NO: 203 - DNA, 240 bp, synthetic construct
  source 1..240: mol_type = other DNA
atgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttga

SEQ ID NO: 204 - DNA, 1047 bp, synthetic construct
  source 1..1047: mol_type = other DNA
atggggttttgcattccattgagatcaaagatgttgaagagaggatctagaaaatcctcttccatactggctaggcgtcctactcctaaaaaaatgaacatagttactgatttggaaaatcgtttaaagaagaatagctatatagaaaatactaatcagggaaacattctgatggatagcatcttcgtatccactatgccggtagaaacattgtttggatcgtacataactgatgacagtgatgattatgaacttaaggatttactcaatgttacatataacattaaaccggtcatagttcctgacatcaagttagatgctgtattagatagagatggaaattttagaccagctgactgtttcttggttaaactgaaacatagagatggattcaccaaaggagctctctatcttggtcacagtgcaggatttacggcaacaatctgcttaaaaaatgagggggtttcagggctttacattccaggtacttctgtaattcggtccaatatctgtcaaggagatactatcgtcagtagatcatctagaggagttcaatttcttccacaaataggaggagaagctatcttcttgattgtttcactttgtcctaccaaaaagttagtagaaacaggattcgtcattccagaaatatcgtcaaatgataacgccaaaatcgctgctcgcattctatcagagaaacgcaaggacaccattgcgcatattaatactctaatacaatacaggcaacaattggaattggcttactataattcctgcatgttaaccgagtttctgcattattgtaattcgtatgctggcaccatcaaagaatcacttctaaaagaaacaattcaaaaagatatcaatatcacacatacaaatattactaccctattgaatgagacagccaaggttatcaagttagtaaaatctctggtagataaagaagatactgatattgtgaataatttcattactaaagaaattaaaaacagagacaaaatagttaatagtttgtctctatcaaacctggactttcgtttgtaa

SEQ ID NO: 205 - DNA, 162 bp, synthetic construct
  source 1..162: mol_type = other DNA
atggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattga

SEQ ID NO: 206 - DNA, 162 bp, synthetic construct
  source 1..162: mol_type = other DNA
atgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctga

SEQ ID NO: 207 - DNA, 1908 bp, synthetic construct
  source 1..1908: mol_type = other DNA
atgttaaacagggtacaaatcttgatgaaaacagctaacaattatgaaactattgagatattgcgtaactatttaagactgtatatcattttggcacgaaatgaagaaggtcatggtatactaatatacgatgataacatagatagtattatgtcgatgatgaatattacaagattagaagttataggattgacgactcattgcacaaaattaagatcatcgcctccaattcctatgtctagattgtttatggacgaaatagatcatgagtcatattattctccaaaaacttcagattatccgttgatcgatattatacgaaagcgttcccacgaacagggagatatagcactggctttagaacaatacggtatcgagaatacagattccatatcagaaattaatgaatggttgtcgtcaaaaggtttagcatgttatagatttgtaaaatttaacgattacaggaaacagatgtatcgtaagttctctaggtgtactatagttgacagtatgataatagggcatataggtcatcattatatttggattaaaaatttagaaacatatacgcgtcccgaaattgatgtgttaccgtttgatattaaatacatatctagagatgaattgtgggcgcgaatttcttcctcgttagatcaaacacatataaaaaccatcgccgtatcagtttatggagctattactgataatggaccaatgccatatatgatatccacgtatccgggtaatacctttgttaactttaacagtgtaaaagatctaattttatatttcttagattggattaaagatattatgactagtacacgaactatcattctagtaggttacatgagtaatctattcgatataccgttgctaacagtatactggcccaataactgtggatggaaaatctataataatacattaatatcatccgatggtgctagggttatttggatggatgcgtataaattttcttgcggtttatctttacaagactattgttatcattggggtagcaaaccagagagccgaccattcgatttaataaaaaaatcagatgctaaacgcaattctaaatcgttggtcaaagaatctatggcatccttgaaatccttgtacgaggcattcgagacacaatcaggagcgttagaagttttaatgagtccatgtaggatgttttcgttttctagaatagaagacatgttcttaactagtgtcattaatagagtatccgagaatactggaatggggatgtattatcctaccaacgatataccttttctatttatcgaatcatctatctgtctagattatattatagtaaataatcaggaatccaacaaatatcgtatcaaatctgttctcgatatcatttcttcaaaacaataccctgcaggacgtcccaactacgttaaaaatggtacaaaaggaaagttatatatcgcgttgtgtaaagttaccgtacctactaacgaccatattccagtagtttatcacgatgatgacaatactaccacctttattacagtattgacgtccgtcgatattgaaactgctatcagagcaggatattcgatagtcgaattaggggctttacaatgggatgataatattccagaacttaaagactgtttactggatagtatcaagatgatttatgacttgaacgcagtcacaacaaataatttattggaacagctcatagaaaatattaactttaacaactctagtataatttcgttgttctatacatttgccattagttattgccgagcattcatttactcaattatggaaaccatagatccggtgtatatatctcagttcagttataaagaattatacgttagtagctcttataaagatattaatgaatccatgagtcagatggtaaaattataa

SEQ ID NO: 208 - DNA, 216 bp, synthetic construct
  source 1..216: mol_type = other DNA
atgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatga

SEQ ID NO: 209 - DNA, 150 bp, synthetic construct
  source 1..150: mol_type = other DNA
atgatagttcgtgtactagtcataatatctttaatccaatctaagaaatataaaattagatcttttacactgttaaagttaacaaaggtattacccggatacgtggatatcatatatggcattggtccattatcagtaatagctccataa

SEQ ID NO: 210 - DNA, 1119 bp, synthetic construct
  source 1..1119: mol_type = other DNA
atgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgagtacgactaggggagcgcttatttttgataaactaaaagaggcatctgaaaaagggattaaaataatagttttgctagatgaacgagggaaaagaaatctgggagagctacaaagtcactgcccggatataaattttataaccgttaatatagataaaaaaaataatgtgggactactactcggttgtttttgggtgtcagatgatgaaagatgttatgtaggaaacgcgtcatttactggaggatctatacatacgattaaaacgttaggtgtatattctgattatcccccgctggccacagatcttcgtagaagatttgatacttttaaagcctttaatagcgcaaaaaattcatggttgaatttatgctctgcggcttgttgtctgccagttagcactgcgtatcatattaagaatcctataggtggagtgttctttactgattctccggaacacctattgggatattctagagatctagataccgatgtagttattgataaactcaggtcagctaagactagtatagatattgaacatttggccatagttcccactacacgtgtcgacggtaatagctactattggcccgacatttacaactccattatagaagcagccattaatagaggagttaagatcagacttctagttggtaattgggataagaacgacgtatattctatggcaaccgccagaagtctagacgcgttgtgtgttcaaaatgatctatctgtgaaggttttcactattcagaataatacaaaattgttgatagtcgacgacgaatatgttcatatcacttcggcaaatttcgacggaacccattaccaaaatcacggattcgtcagttttaatagtatagataaacagcttgtaagcgaggctaaaaaaatatttgagagagattgggtatctagccacagtaaatcgttaaaaatttaa

SEQ ID NO: 211 - DNA, 144 bp, synthetic construct
  source 1..144: mol_type = other DNA
atggccaaatgttcaatatctatactagtcttagctgacctgagtttatcaataactacatcggtatctagatctctagaatatcccaataggtgttccggagaatcagtaaagaacactccacctataggattcttaatatga

SEQ ID NO: 212 - DNA, 222 bp, synthetic construct
  source 1..222: mol_type = other DNA
atgaaacacagattgtattctgaaggattgagtattagtaatgatttaaactcgataatcggtcaacaatctacaatggatacggatatagaaataaacgaagatgacatcatggaacttcttaatatattgactgagttaggttgtgatgtcgactttgatgaaaattttagcgatatagccgatgatattctagaatcgttgatagaacaggatgtataa

SEQ ID NO: 213 - DNA, 150 bp, synthetic construct
  source 1..150: mol_type = other DNA
atggtcatcggtttagtcatattcgtgtctgtggcggccgccatcgtcggtgtgttgtctaacgtattggacatgtttatgtacgtagaagaaaataatgaagaggatgctagaatcaaggaggagcaagaactactgttgctatattga

SEQ ID NO: 214 - DNA, 477 bp, synthetic construct
  source 1..477: mol_type = other DNA
atgaggagtattgcggggctacataaattaaaaatggaaatttttaatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataa

SEQ ID NO: 215 - DNA, 696 bp, synthetic construct
  source 1..696: mol_type = other DNA
atgaaagtggtgattgtgactagcgtagcatcgcttctagacgcatctattcagtttcaaaaaacggcatgtaggcatcactgtaattacctatctatgcaagtagttaaagagatagaagaatttggtactatcaatgaaaaaaatttggaatttgacacttggaaagacgttatacaaaacgatgaaatagatgcattagtattttatagagtaaaacaaattagtatttctacgggtgttctatataaatctatgatgcgcaatagaacaaaacctatttccatgtactttgtacgtgattgtttggcatttgatggagatcctccgtcttttagaatgacgtcttgcaatatcaacgcatacaatcgtaataagattaaagatttgataatcctaatgaatatgaaaacatgcaataaaaaaattatcggtgagtttataatagacaattttggaagcgtcgatgcattactatcgataattaattctaatgttacgtggattacatcagttataaataatagtaacggcaggggtattaatatcagggtatcaaataataaaatgttaactataactagttttcgacgatttgtcaataaacttaaaatgtacaaaactactaaatgcgcttctcaattggataatctatgtaccgagatgaacaaaatggatattatagacaaaaaatga

SEQ ID NO: 216 - DNA, 306 bp, synthetic construct
  source 1..306: mol_type = other DNA
atgaattctcattttgcatctgctcatactccgttttatatcaataccaaagaaggaagatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaa

SEQ ID NO: 217 - DNA, 213 bp, synthetic construct
  source 1..213: mol_type = other DNA
atgtccgtcctcataaacggaacttgttttcctgggttattcattctctcgcatctggaaggggacgaaggtcttctctcacacgcgggtgatgagggtttatctactttgagtacgcaggaagctttacttccttcacattctacagttctaacatcgcatactttaacggcttttagaaccaaatatcttccttctttggtattgatataa

SEQ ID NO: 218 - DNA, 1440 bp, synthetic construct
  source 1..1440: mol_type = other DNA
atgaataggaatcctgatcagaatacttttcctaatattacattaaagattatagaaacctatttaggcagagtacctagtgtgaacgaatatcatatgttaaaattacaagctagaaatattcaaaaaataactgtttttaacaaagacatatttgtatctttagtaaaaaagaataaaaaaagatttttttccgatgttaatacatctgcatcagaaataaaagatcgtatacttagctacttttctaaacagactcaaacatataatataggtaaattatttacgattatagaactacaatctgtattagtgaccacatacacggacatattaggagttcttactattaaagctccaaatgtaatttcatctaaaatttcttataatgtaacatcaatggaagaattggcaagagatatgctaaattctatgaacgtcgcagtaatagacaaggcaaaagtaatgggacgtcataatgtatcttccctagtcaaaaatgttaataagttgatggaagaatatcttagacgccataataaaagttgtatatgttacggatcatattctctatatctaattaatccaaatatactatacggcgatatagatattcttcagactaattctaggacttttcttatagatttggcctttctaataaaatttatcacgggaaataatattatattaagtaaaatcccatatcttagaaactatatggtgataaaagatgaaaacgataatcatatcattgatagttttaatattcgccaggataccatgaacgtagttcctaaaatctttatagataatatctatatagtggatccgacgtttcaactattgaacatgataaaaatgttttctcaaatagatagattggaagatctatccaaagatcctgaaaagtttaatgcgcgtatggcaaccatgctagaatacgttagatatacacatggtatagtctttgatggtaagcgtaataatatgccgatgaaatgtatcatcgatgaaaataatcgcatagttactgtcactactaaagactattttagctttaaaaaatgtctagtgtatctagatgaaaatgtgttatcgagtgatatattagatcttaacgccgacacatcgtgtgatttcgagagtgttacaaattctgtatatctaattcatgataatatcatgtatacatatttctcaaatactattctccttagtgataaggggaaggtacatgaaataagtgccagaggtttatgtgcacatatattgttgtatcagatgctgacatctggagaatacaaacaatgtttatcggatctcttaaattcgatgatgaatagagataaaatacctatctattcacatactgaaagagataaaaaacctggacgacacggatttattaatatcgaaaaggatataatagtattttag

SEQ ID NO: 219 - DNA, 2214 bp, synthetic construct
  source 1..2214: mol_type = other DNA
atgatatctgtcacagatattcgtagagcgtttctagacaatgaatgccatactatcacaaaagcgtttggatatctgcacgaggacaaggctatcgcattaattaaaataggatttcatcccacttatctacccaaagtcctttataataatgttgtagaattcgttccagaaaaactatatctgtttaagccaagaactgtagctccattggatttgatatctactataacaaaattaaagaacgtggacaaatttgcctcacacataaattatcacaagaatagtatattgataacaggagacaagtctctaattgttaaatgtatgccttacatgattatttcagatgatgatatacgattcataagagaacagtttgttggtacaaattctattgagtatattctatccttcatcaacaaggaaagcatatatagaatgagttaccaattttcagagaatgaaatagtcactatcatcaatagagatcatttcatgtatgaaccaatatatgaacatcaagtcttagattctgactttcttaaaactatgttagatagatacggaatagttcccattaattctggtataatagatgaattatgtccagaagctataatagagatattaatggcagtagttcgtcctagggacgctatccgtttcttagatatagtgaataagaatcaattgacagaagatagtgtcaaaaactatatcattaatgatatcagaagaggtaaaatagattattatattccatacgttgaagattttttagaagatagaactgaagacttgggaatatatgcgaatatattttttgaggatgctatagatattacgaaactagacatcacaaagacagagttggaacatatatcaaaatacatgaattattacactacttatatagatcacatagttaacatcatcttacaaaataattatatagatatcttggcatctataatagattacgtgcaagacgtattaacagaagaattatgtattagaatagtttgcgaatcaacaaaccctgttcccgttacatctcttcctatacattctacgttagtaatggttatgtgtatacaaatgaaatatgtcgatatagttgaattcttagacgagatcgacatcgatactttaatagaaaaaggagcagatccgataaccgaatacacatttacaacaagatggtacaataaacacaatgatttgatcactctttacattaaaaaatatggattctgtccaatgatgatgaaacggttaatgttcgaatatccattgactaaagaagccagtgatcatttacttaaaaccatggatgaaaacaggggagctattatgttttttccgcgtactatttgcacacttccttatctattatgttgtaattataaactaattcaaaaacctattccattcaaagaagaaaatcgtaacatcgtatataagaaaaacaacagagtattatgctttgactcgttggagaactctgcgtttaaaagcctcattaaaatagattctattccaggattaaaaacttataacatgaaagacattacatacgaaaagtctaataatataatttgtgttaggtttatacctcaagaatcaattcataatgaagagcgaagaataaaattacagttattcgacattgctagattggcatcctatggactatattatattccctctagatatttatcatcgtggacaccagtagtgaacatgatagagggaagagagtacactaatccacaaaaaatagaatgtctagttattttggatttattttcagaggaattcatagaatatcaaaatctgggcaatgcggtatctaataaatatgaactggaatatactatatctaattatcaagctgccataaactgcctaatgagcacgttattaatatatctagttctaggatcaatcagatcgatatcaaaaactgaagattttgtattatctatattaaatatcttctataaaggactgaaaattaatgaattactttctgaaccagtatcaggagtttgtatcgaattagataaaataaaagatagagcgagctctggagacagtagttttatatttcttaagaaaaacgagttatcaaaaactctatcgctctgtgaaaaagtttgcgtagagaccatattagacaataatcagagttttaaatcctcaaaatga

SEQ ID NO: 220 - DNA, 174 bp, synthetic construct
  source 1..174: mol_type = other DNA
atggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatag

SEQ ID NO: 221 - DNA, 126 bp, synthetic construct
  source 1..126: mol_type = other DNA
atgaattcctctgaaaataaatccaaaataactagacattctattttttgtggattagtgtactctcttccctctatcatgttcactactggtgtccacgatgataaatatctagagggaatataa

SEQ ID NO: 222 - DNA, 573 bp, synthetic construct
  source 1..573: mol_type = other DNA
atgtctaagatctatattgacgagcgttctgacgcagagattgtgtgtgcggctattaaaaacattggaatcgaaggagctactgctgcacaactaactagacaacttaatatggagaagcgagaagttaataaagctctgtacgatcttcaacgtagtgctatggtgtacagctccgacgatattcctcctcgttggtttatgacaacggaggcggataagccggatgctgatgttatggctgacgccataatagatgatgtatcccgcgaaaaatcaatgagagaggatcataagtcttttgatgatgttattccggctaaaaaaattattgattggaaagatgctaaccctgtcaccattattaatgagtactgccaaataactaagagagattggtcttttcgtattgaatcagtggggcctagtaactctcctacattttatgcctgtgtagatatcgacggaagagtattcgataaggcagatggaaaatctaaacgagatgctaaaaataatgcagctaaattggcagtagataaacttcttggttacgtcatcattagattctga

SEQ ID NO: 223 - DNA, 780 bp, synthetic construct
  source 1..780: mol_type = other DNA
atggaaaatgtatacattagtagttactcatccaatgaacaaacatcaatggcggtagccgctactgatatccgagaattactatcacaatatgtggatgatgccaacttggaagacttaatagaatgggccatggaaaaatcatcaaagtactacatcaagaatataggtaatacaaaatctaatatcgaagaaactaaattcgaatcaaagaataatattggtatagaatactcaaaggattccagaaacaaactatcgtatagaaataaaccgtctattgccacaaatttggaatataaaacactatgtgatatgattaagggtactagcggcaccgaaaaagaattccttcgctatctcttattcggtataaaatgcattaagaaaggagtagaatacaatatagataaaataaaggatgtgagttacaacgattattttaacgttctcgacgagaaatacaatacaccgtgtcctaactgtaaaagtaggaatactacgccgatgatgattcaaactagagccgctgacgaacctccactagttagacatgcgtgtagagattgcaaacaacactttaagcctcccaaatttagagcatttcgcaatcttaatgttacaacgcaatcgatacatgaaaacaaggaaataacagagattcttccagataataatccatctcctccagaatctccagaaccagcatcacctatagatgacgggttaatcagatccacattcgatagaaacgacgaaccaccagaggatgatgaataa

SEQ ID NO: 224 - DNA, 996 bp, synthetic construct
  source 1..996: mol_type = other DNA
atgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaatag

SEQ ID NO: 225 - DNA, 321 bp, synthetic construct
  source 1..321: mol_type = other DNA
atgtttaattttagtgtatccaatccaataaatccattttctacatcatcatcgtatctgtacgctttgtattctccactcttgaacaaatctctaaacagtatcttcaacactttttccaccaattcctgggatgtcacacattgttctaccatctgtttgataaagagggtatcttcttcagattctcccttgattctatacatgggttttaggttataccttgcatctattgtatatttatcagattcagctatcaacattttatcaacttgtgttccaattattttccatttattagatctgcattcattattatag

SEQ ID NO: 226 - DNA, 1704 bp, synthetic construct
  source 1..1704: mol_type = other DNA
atggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacagggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatag

SEQ ID NO: 227 - DNA, 501 bp, synthetic construct
  source 1..501: mol_type = other DNA
atgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataa

SEQ ID NO: 228 - DNA, 213 bp, synthetic construct
  source 1..213: mol_type = other DNA
atgctacatgagttccatgtgcggagattgttaaagtttagggtagagagttgttctagcatccattcattgtctttacatccgttatatgtaattatgtcacccatggacattataggttttaatagtacttcagatactggaataagatattgttcgtatatgtgtttgataatcatttgttgcgtttctggagaacttttctctgcatga

SEQ ID NO: 229 - DNA, 822 bp, synthetic construct
  source 1..822: mol_type = other DNA
atggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaa

SEQ ID NO: 230 - DNA, 201 bp, synthetic construct
  source 1..201: mol_type = other DNA
atggaagtcagtaacaaaaaactaataaactcgtttgttggaagagcagaaaactttcgaagatatgatacgtatctaccagagaacgatccattagcaatgaattcagtatttactttttcttcgtatactggaataggacctttatatagagacatgagaaactcgaactttttaagtaatcccaacgaaatgggataa

SEQ ID NO: 231 - DNA, 3021 bp, synthetic construct
  source 1..3021: mol_type = other DNA
atggatgttcggtgcattaattggtttgaaagtcacggtgaaaacagatttttatatctgaaatccagatgtcgaaatggtgagaccgtatttatacgatttcctcattacttttattacgtagtgacggacgaaatatatcagtcattgtctcctcctccatttaatgcgaggccgttgggaaagatgagaactatagacattgacgagacaataagttataatctagatattaaagatagaaaatgctccgtcgcagatatgtggttgatagaagagccaaagaaacgcagcatacaaaatgccaccatggatgaatttctcaatattagttggttttatatttctaacgggatatctccagacggatgttactcgttggacgagcaatatttgacaaagattaacaatggatgttatcattgtgacgatccacgtaactgtttcgctaaaaaaatacctagattcgatatcccaagatcgtacttatttctagatatagagtgtcacttcgataagaagtttccttctgtatttattaacccaatctcgcatacaagttactgttatatcgatttaagtggtaaacgattattgtttacgctcattaatgaagagatgttaacggaacaggaaatacaagaagccgtcgatagaggatgtttgaggatacagtcactaatggaaatggattacgaacgagaactagttttatgttctgaaatagttttgttacgaatagctaaacaattgttggaactaacgttcgactatgtcgttacctttaacggacataactttgatctgagatatattactaatcgtctagagttattaacaggagagaagattatctttagatctccggacaaaaaggaagctgtacatctctgtatttatgagagaaatcagtctagtcataagggagtaggcggcatggccaatactacgtttcacgttaataacaataatggaactatatttttcgatctatattcattcattcaaaaatctgaaaaattggattcgtacaaattggattctatatccaagaacgcgttcagttgcatgggtaaagtattaaatagaggagttagagaaatgacgttcatcggtgacgatactacggacgcgaaaggcaaagccgctgcatttgcaaaggttttaaccacaggtaattatgtgactgttgatgaggatattatatgtaaagtaattcgtaaagatatttgggaaaatggatttaaagtcgtactattatgtcctactttacctaatgatacatataaattatctttcggaaaggatgacgttgatttagctcagatgtataaggattataatctaaacatagctttagatatggctagatactgtattcatgatgcttgtttgtgtcagtatttgtgggagtattatggagtagaaacaaaaacagacgcgggtgcgtcaacatatgtgcttcctcaatccatggtattcgaatatagagcgagtacagtcatcaagggtccactgttaaagctattgttggaaactaaaactatcttagttagatcagaaacaaaacaaaagtttccttatgaaggcggtaaggtatttgctccaaaacaaaaaatgtttagtaataatgtattaatctttgattataacagtctgtatcctaatgtgtgtatctttggaaatctatctccggaaacattagtcggtgtcgttgttagtaccaatagattggaagaagaaataaataatcagctcttgcttcagaaatatccacctcctagatatattacggttcattgtgaacctagactaccgaacctcatctctgaaatagcaattttcgatagatcgatagaaggaaccattcctagactattaagaacatttttggcagagagagccagatataaaaagatgttaaaacaggctaccagttcaactgaaaaggccatctatgattccatgcaatatacgtacaagatagtagccaactcagtatatggtctgatgggatttagaaatagtgctctatactcatacgcttcggctaagagttgcacatccataggacgtagaatgatcttgtatctagaatcggtactaaatggagcagagttatctaacggtatgttacggtttgccaatccattaagtaatccattttatatggacgatagagatattaatccgattgtgaaaacatcgttgcctatagattacagatttcgttttcgtagcgtgtatggagataccgactccgtgtttacagagatagacagtcaagatgtagataagtccatagaaatagcaaaggagttagaacgactgattaataatagagtattgtttaataattttaaaatagagtttgaggcggtatataagaatctgattatgcaatcgaagaagaaatatacaacgatgaaatactcggcatcgtcgaattcaaaatctgtacctgagagaattaataaaggtactagtgaaactagaagagatgtttccaagtttcataagaatatgattaagacatacaagaccagactgtctgagatgttgtctgaaggacggatgaattctaatcaggtatgtatagatattctccgttctttagaaacagatttacgatccgaatttgatagtagatcgtctcctctagaattatttatgttgagtcgaatgcatcactcaaattataaatccgcagataaccctaatatgtatttggttactgaatataataaaaataatccagaaactatagaacttggagaacgatattattttgcatatatttgtccggctaatgtaccatggaccaaaaaacttgtaaatattaaaacatatgaaacaattatcgatagaagttttaaactcggcagtgatcaaagaatattttacgaagtttactttaaacgattgacgtccgaaatagtcaatctattggataataaagttttatgcatctcattctttgaaagaatgtttggttcaaaacctacattttacgaagcataa

SEQ ID NO: 232 - DNA, 159 bp, synthetic construct
  source 1..159: mol_type = other DNA
atggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatga

SEQ ID NO: 233 - DNA, 198 bp, synthetic construct
  source 1..198: mol_type = other DNA
atgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctag

SEQ ID NO: 234 - DNA, 183 bp, synthetic construct
  source 1..183: mol_type = other DNA
atgacattattgtcctctatagcgatagtcgcgtgccgtctacatgcaggacatggaagagtgctaactatagtatatagttttcgtttacacgcttctatgttgccgtctaaacccgcttgcgaaagtactataaaaataatggtccatacggctcttccccaatgtttgggattcatttaa

SEQ ID NO: 235 - DNA, 288 bp, synthetic construct
  source 1..288: mol_type = other DNA
atgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataa

SEQ ID NO: 236 - DNA, 390 bp, synthetic construct
  source 1..390: mol_type = other DNA
atggaactcgttaatatttttttagaaacggatgctggaagagtaaagtttgccataaaaaataccgacgatgtatgtgcctcggagttaataaataaatttgtggaactgttaagtgaatacattcacattgaccaatcagaattttatttggtggtaaaggataaggatattttttattttaagtgtgatagggggtctatttcgattgtaaacaatgagttttatgtctttgacgaacccttgctgtttgttaaagatttcactaatgtaacgggggttgaattcatagtcacagaaaccatgccgtgtagaattataccaaaaaataatcacgcggttatttcagtcgtgactaatcataagttttataatgggttaagtttataa

SEQ ID NO: 237 - DNA, 147 bp, synthetic construct
  source 1..147: mol_type = other DNA
atgtattcacttaacagttccacaaatttatttattaactccgaggcacatacatcgtcggtattttttatggcaaactttactcttccagcatccgtttctaaaaaaatattaacgagttccatttatatcatccaatattattga

SEQ ID NO: 238 - DNA, 2001 bp, synthetic construct
  source 1..2001: mol_type = other DNA
atgttcatgtatccggaatttgcgaggaaggctttatcaaagcttatttcaaaaaaattaaacattgaaaaggtgtctagcaagcaccagctcgtgttactggattatggattacacggactattgccaaaatcactgtatctggaagctattaattccgatattctcaatgttaggttttttcctcctgaaataataaacgtcactgatatcgttaaggctctccaaaattcttgtagagtagatgagtacctaaaatctgtttccttatatcataagaattctttaatggtatcgggaccaaatgtagtcaagcttatgatagaatataatcttcttacacacagtgacttggaatggttaattaatgagaatgtagtcaaggctacataccttttaaaaatcaatgcctatatgattaactttaaaatagatctaacggttgatgaaatcattgacttagttaaagatattcctgtaggagctacactacatctatataatatattaaacaatatagatttggacattgttcttcgtatatctgatgaatataatataccacctgttcacgatattctgtctaaacttaccgatgaagagatgtgtataaaactagttacaaagtatcctatggacaatgttataaattttattaatcaagatgttagatatagtcccaccttcatcaagacaattaaagattttgtcaacgagcatcttccaaccatgtacgatggattaaatgattatctacattctgttattatcgacgaggacttaatagaggaatataaaattaaatccgttgccatgtttaatttggaatacaaaactgatgtaaatactctaacattggacgaacagatatttgtagaggtaaacatctcatattatgattttagatatagacaatttgccgatgaatttagagattacattatgataaaagaaagaagacaaatcaccatgcaatctggtgatagaataagaaggtttagacgtcccatgtcattgagatccactatcatcaaaaaggatactgattctctagaggatattctcgcacatatagataatgccagaaaaaatagcaaggtatccattgaagatgttgagagaatcatttcatctttccgtcttaatccttgtgttgtcagacgcaccatgctgtctgatatagatatcaaaacaaagataatggtgctaaaaattgtcaaagattggaaatcttgtgctctgacactatcagccatcaaaggaattatggtaacagataccatcaataccgtgttatccaaaattctgcatcatcataggaatgtcttcaagtatcttacatctgtagagaataaagaaattgctgtctgtaattgctccagatgtctgtcgctcttctatagagaattaaaaagtgtacgatgtgatctacgcacagacgatggattattggataggctatacgatctgactagatacgccttacacggaaaaatcaatcaaaacttaatcggtcaacgatgttggggtccgttgacagaaatgctgtttaacgagaataaaaagaaaaaactaaataatttaatggaatacatcaaaatatcagacatgttggtatacggacactccatcgagaagacgcttattccaattactgattctctttcattcaagctatctgttgataccatgtctgtgttaaatgatcaatatgccaaggttgtcatcttcttcaataccatcatagaatatattatagctactatctattatagattgacagtcttgaacaattatactaatgtcaaacattttgtatccaaagtgttacacactgtcatggaagcatgtggcgtactgttttcatacattaaagttaatgacaaaatagagcatgaattggaggagatggtggacaaaggtaccgtaccttcttatttgtatcatttgtccatcaacgtcatttcaataatattggatgatataaatggaactcgttaa

SEQ ID NO: 239 - DNA, 177 bp, synthetic construct
  source 1..177: mol_type = other DNA
atggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttga

SEQ ID NO: 240 - DNA, 348 bp, synthetic construct
  source 1..348: mol_type = other DNA
atggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaa

SEQ ID NO: 241 - DNA, 327 bp, synthetic construct
  source 1..327: mol_type = other DNA
atggccgaggaatttgtacaacaaaggttggccaataacaaagtgacaatttttgtcaagtatacatgtcctttttgtagaaatgcactggatattctaaataagtttagtttcaaaagaggagcgtatgaaattgtcgatattaaagaatttaaacccgaaaatgaattgcgtgactattttgaacaaattactggtggtagaactgttcctagaatcttttttgggaaaacttctattggtggatatagcgacctgttggaaatagacaacatggacgcattgggtgatattctatcatctattggggtattgagaacttgttga

SEQ ID NO: 242 - DNA, 939 bp, synthetic construct
  source 1..939: mol_type = other DNA
atggcggaatttgaagatcaactcgttttcaatagtatcagtgcccgtgcattgaaagcttatttcactgctaaaatcaatgaaatggtagatgagttggtcacaagaaaatgtccacaaaagaaaaaatcacaagctaagaaacctgaagtacgcattcctgtagatcttgtaaagtctagttttgtgaaaaagtttggattgtgcaattatggaggaatccttatcagtcttattaatagtctagtagaaaataatttctttacaaaggatggaaaactggatgatacaggcaaaaaggaattggttttgacagatgtcgaaaaacgaattcttaataccatagataaatcatctcctttgtatatcgatattagtgatgttaaagtattggctgctagactaaaaagaagcgctacacaatttaactttaatggacatacatatcatctggaaaatgataaaatagaagatctcattaatcagttggttaaggacgaatccattcaactggatgaaaagagttctattaaagatagtatgtatgtcattcccgatgaacttatcgatgttctcaaaactagattgtttagatctcctcaagtcaaggataatattatttcgcgtactagattgtatgattattttactagagttactaagagagacgaatcgtcaatctatgtgattctaaaggatcctaggatcgctagcattttgtcactagaaactgttaaaatgggcgcctttatgtatacaaaacatagtatgttgacgaacgctatttcatctagagtcgatagatattctaaaaagtttcaagaatctttttacgaagatattgcagaatttgttaaagaaaatgagagagttaatgtatcgagagtggttgaatgtttgactgtgcctaatattactatatcaagtaatgctgaataa

SEQ ID NO: 243 - DNA, 222 bp, synthetic construct
  source 1..222: mol_type = other DNA
atggataagttgtacgccgctatatttggtgtatttatggggtctccggaagatgatttgacagactttatagaaattgttaaatctgttctaagtgatgagaaaacagtcacatcaactaataataccggttgttggggttggtattggttaattattattttttttatagttcttattctactactattgatatatttgtatttaaaagttgtttggtga

SEQ ID NO: 244 - DNA, 810 bp, synthetic construct
  source 1..810: mol_type = other DNA
atgagtaaggtaatcaagaagagagttgaaacttcaccaagacctactgcatctagcgattctctacagacttgtgcgggtgttatagagtatgcaaaatcgattagtaaatctaatgcaaaatgtatcgaatacgttacactaaatgcttctcaatacgctaattgttcgtctatctctataaaacttactgatagtttatctagtcaaatgacttccacttttattatgttggaaggagagactaaactttataaaaataaatctaaacaagatagaagcgatggatactttctaaaaataaaagttaccgcggctagtcctatgttgtatcaacttctagaagccgtctatggaaacattaagcacaaggaacgcattccaaattctttgcatagtctttcggtggaaactattacagagaaaacatttaaggatgaatccatcttcatcaacaaattaaacggagccatggtagaatatgtttcgactggagaatcatccattctcagatctatagaaggtgaactagaatcactcagtaaaagagaaagacaattggccaaggcaattatcacacctgtagttttctatagatccggaacggaaacaaaaattacattcgcactcaagaaactaatcattgatagagaagtggtggctaacgttatcggactctctggagatagtgaacgtgtatcaatgactgaaaatgtagaagaagatctggctcgtaatctgggacttgttgatattgatgatgaatatgatgaagatagcgataaagaaaagccaatattcaatgtataa

SEQ ID NO: 245 - DNA, 156 bp, synthetic construct
  source 1..156: mol_type = other DNA
atggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatag

SEQ ID NO: 246 - DNA, 2316 bp, synthetic construct
  source 1..2316: mol_type = other DNA
atgtttgtcattaaacgaaatggatacaaggaaaatgtcatgtttgataaaatcacgtctcgtattagaaaattatgttatggcttaaacacggatcatatagatcctattaaaatagctatgaaggttattcaaggaatatataatggagtaacaacggtagaattggacactctggcagccgaaatagcagccacttgtactacacaacatccggattatgccattctagccgccagaatagccgtatcaaatctacacaaggaaacaaaaaaactatttagtgaagtgatggaggatttattcaactatgttaatcctaaaaatgggaaacattctccgattatttcaagtatcaccatggatatagttaacaaatataaggataaactcaactcggttattatttacgaacgagacttttcatacaactattttggttttaaaactttggaaaaatcctacttgttgaaaataaacaacaagatcgttgaaagacctcagcacatgttaatgcgtgtcgcagtaggaattcatcaatgggatatagactcagctattgagacgtacaatctactttctgaaaaatggtttacgcacgcttctcctaccttatttaatgcgggaactagtcgtcaccaaatgtctagctgttttctacttaacatgatcgatgatagcatagagggtatctatgacacgttaaaacgatgcgcattaatctctaaaatggcagggggaataggtctatcaattagtaatattcgtgccagtggaagctatatctccggtaccaatggtatatcaaacggtattattccaatgttgagagtttataataacaccgctagatacatagatcagggaggaaacaaacggcctggagttatggccatatacttggaaccgtggcattctgatattatggcgttcctcgatcttaaaaagaatacaggaaacgaggaacatagaaccagagatctatttatagctctttggattcctgatctctttatgaaacgagtgaaggatgacggagagtggtcgttgatgtgtccggatgaatgtcctggattggacaatgtttggggagacgagttcgaacgattgtatacactatacgaaagagaaaggagatacaaatctataataaaggctcgagtcgtctggaaagcgattatagaatctcagattgaaactggtactccattcattctttataaggatgcgtgtaacaaaaagagtaatcaacaaaatttaggaactatcaagtgtagtaatctttgcactgagataatacaatatgcggatgctaatgaggtagccgtttgtaatctggcatctgttgccttgaacatgtttgtaatagatgggcgatttgattttctcaaactgaaggatgtggtcaaagtaattgtcagaaatctcaataaaattatagatattaattattatcctattccagaagctgaaatctctaataagagacatagacctatcggtattggtgttcaaggattagcggacgcgtttattctcttaaattatccatttgatagcctggaagcacaagatctaaataagaagatcttcgaaaccatttattacggtgcattagaggcgagttgtgaactagctgagaaggaaggaccatacgatacatatgtaggatcgtacgccagtaacggtattctacaatatgatctttggaatgttgtaccgtcggatctttggaattgggaacctctaaaagataaaatcagaacatacggtcttagaaatagtttattggtggcacctatgccgactgcatcaactgctcaaattttgggaaataatgagtcggtggaaccgtataccagtaatatttacactcggagagtattgtctggagaatttcaagtagttaatccgcatctccttagagttttaaccgagagaaaattatggaatgatgagatcaagaataggattatggcagatggtggatccattcagaatacaaaccttccagaagatattaagcgagtttataaaactatttgggaaattccacaaaagacgatcataaaaatggctgcagacaggggagccttcatcgatcaaagtcaatctatgaatatccatatagcagatccgagttattccaaactaacgagtatgcatttttacggatggagtctcggtctaaaaacgggaatgtactatctacgtacgaaacccgcatccgctcccattcaattcacattggacaaggataaaataaaaccaccggtggtttgtgattccgaaatctgtacatcatgcagtggttaa

SEQ ID NO: 247 - DNA, 183 bp, synthetic construct
  source 1..183: mol_type = other DNA
atggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataa

SEQ ID NO: 248 - DNA, 234 bp, synthetic construct
  source 1..234: mol_type = other DNA
atgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaa

SEQ ID NO: 249 - DNA, 165 bp, synthetic construct
  source 1..165: mol_type = other DNA
atgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttga

SEQ ID NO: 250 - DNA, 240 bp, synthetic construct
  source 1..240: mol_type = other DNA
atggtggatgctataaccgttctaactgcgataggcataactgtattaatgcttttgatggtaatttctggtgccgccctgatagtcaaggagttaaatcctaatgatatattcactatgcaatcattaaagtttaatcgagccgtaacgattttcaaatatataggactctttatctatataccaggaacaatcattttgtacgctacgtacgtcaaatccctattaatgaaaagttaa

SEQ ID NO: 251 - DNA, 1149 bp, synthetic construct
  source 1..1149: mol_type = other DNA
atgaataactttgttaaacaagtagcttcaaagtctctaaaacctaccaaaaaattgtctccgtcagatgaggtgatatctttaaacgaatgcataatatcctttaacttggataacttttattattgcaacgatgtactgtttactaagcccattaatactccggaggatgttctcaaatcactcttgatcatggaatcattcgcgtacgagaagatgataatcaaaggattaataaaaatactaatatttagagcatatattaatgatatttattttactccattcggttggttgacgggcgtcgacgatgatcctgaaacacacgtggtgataaaaataattttcaattcatcactaatatctatcaagtctcaagttatagaatatttaaaaccatacaatgtcaataacctatcggtacttaccacagaaaaagaattaagtattaatacgttcaatgttccggattctatacctatgtcgataatttcgtttttcccattcgatacagattttatactagttattttgttttttggagtatataatgactcgtattgtggaataagctatataagtccgaaagagagactaccgtatatcatcgaaatattaaaaccgttggtgtcggaaattaacatgttatcggatgaaataggtagaacatcatccattagaatcttcaattccactagcgtcaaaaaatttcctactaatacattaacatccatttgtgaaattgtttattcgtttgacgaatcatcctttccgacgcccaagacgttcactcctctaaacgcgagtccatacattcctaaaaagatagtttcactattggatttaccatctaatgtggaaataaaggcgatatctagaggcggtgtggatttcatcactcatattaataataagcgtctaaacacaatcttggtaatagcaaaagataactttttaaaaaattctacattttctggaacttttatcaaagagaatattatttggaagggtatctatacttatagaataatcaagtctagttttccagttcctactattaagtcggttactaataaaaaaaaaatatgtaagaaacattgttttgtcaattctcaatatacaactaggactttgtcacatattctttga

SEQ ID NO: 252 - DNA, 150 bp, synthetic construct
  source 1..150: mol_type = other DNA
atgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataa

SEQ ID NO: 253 - DNA, 162 bp, synthetic construct
  source 1..162: mol_type = other DNA
atggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatag

SEQ ID NO: 254 - DNA, 1272 bp, synthetic construct
  source 1..1272: mol_type = other DNA
atggaaagatatacagatttagtaattagtaaaataccagaactaggatttaccaatttattatgtcatatatattcactagctggattatgtagcaatatagatgtatctaaatttttaacaaattgtaacggatatgtagtggagaaatatgataaatctacaaccgctggcaaagtgtcttgtattcctatcggtatgatgttggaactagtagagttggggcacctgagcagacccaatagtagcgacgaactcgatcaaaagaaagagttaaccgacgagttaaagacgcgttaccattctatatatgatgtctttgagttacctactagtataccgttagcgtatttctttaaacctcgactacgggaaaaagtatctaaggcgatagacttctcacaaatggatttgaaaatcgatgatttatcacgtaaaggaatacatactggtgaaaatccaaaggtcgtcaagatgaaaatagagcctgagagaggagcctggatgagcaatcgaagtattaagaacttagtctctcagtttgcttatggatccgaagtggattatataggacaatttgacatgagattcttaaactccttagcgattcatgaaaaatttgacgcgtttatgaataaacatatcttatcgtatatacttaaagacaaaattaaaagttctacctctagatttgtaatgtttggattttgttatttgtctcattggaaatgtgtaatttatgataaaaaacaatgtttagtatccttttatgactccggaggcaatattccaactgaattccaccactataataatttttatttctattccttctccgatggttttaacacgaatcacagacattctgtattggataatacaaattgtgacatcgatgttttattcagatttttcgaatgtacatttggagcgaaaataggctgtattaatgtagaagttaatcagctgttggaatctgaatgtggaatgtttattagtttgtttatgatattgtgtactaggacaccacctaagagtttcaaatctctgaaaaaggtttatacattctttaaatttttagcggataagaaaatgacattatttaagagcattctatttaacctgcacgatctatcactggatataacggaaacggataacgcaggattaaaagaatataaacgtatggaaaagtggaccaaaaagtcaattaatgtgatatgtgataaattaactacaaaattaaatagaatagtaaacgacgatgaataa

SEQ ID NO: 255 - DNA, 2031 bp, synthetic construct
  source 1..2031: mol_type = other DNA
atggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaa

SEQ ID NO: 256 - DNA, 195 bp, synthetic construct
  source 1..195: mol_type = other DNA
atgtgtgcgggttttcctagtgatggaggagatactttttttccacgtgcttctgtactaactttgtatattcctttatgttttacaacgtgtgcgttatgccatctatgttttataactggaaacacggccaatgagaaactatcacgttccgttttactcatattactgaattcatcttgtgaatatttgtaa

SEQ ID NO: 257 - DNA, 1776 bp, synthetic construct
  source 1..1776: mol_type = other DNA
atgattgtcttaccgaataaagttcgtattttcatcaacgatcggatgaaaaaggatatctacttgggaatttctaatttcggattcgagaatgatatagatgaaatcttgggaattgctcacttgttggaacatctacttatatcctttgattctactaattttttagcgaatgcttctacatctagaagttatatgagtttttggtgtaaatccattaattcagcaacggaatcggacgcaatcagaacattagtttcgtggttcttttctaacggaaaactcaaagataatttttccctttctagtatacgatttcacattaaagaattagaaaacgaatactattttagaaatgaagtattccattgtatggatatactaacgtttcttagcggaggcgatttatataacggtgggagaatagacatgatagataatcttaatatagttcgtgatatgctggtaaatagaatgcaaaggatatcgggatcgaatatcgtaatttttgttaagagattaggacctggaacattggatttcttcaaacagacatttgggtctttaccagcatgtccggagattattccttcgtctattccagtaagtacaaacggtaaaatagttatgactccgtctccattttatacagttatggtaaagattaatccaacattagataatattttagggattctgtatttgtacgaaacttaccacttaatagactatgagactatcggcaaccagttatatttaacggtatcctttatcgatgaaactgaatacgagagctttcttcgtggcgaggctatattacaaattagtcaatgtcaaagtattaatatgaattatagcgacgattatatgatgaacatctatttgaattttccttggctatcgcatgatttatatgattacattacacgtattaatgacgatagcaagtcgatactaatatccttgacaaatgaaatatatgcatctataattaatagagatatcatagttatttacccaaactttagtaaggccatgtgtaacactagagatacccaacaacatccgatagtagttcttgacgcaacaaatgatggactaattaagaaaccttatagaagtatacccctaatgaagcgtctaacatctaatgaaatatttatacgatacggagacgcgtctctcatggacatgataactttatcattgtctaaacaagatatatcattaaaaagaaatgccgaaggaatacgtgtaaaacatagtttttcagctgatgatatacaggcaattatggaatctgattcgtttttaaagtatagtagatcaaaaccagctgcgatgtatcaatatatatttctatcattttttgctagtggtaattccatagatgacatattggcaaatagagattctaccttagaattttctaaaagaactaaaagtaaaattttgtttggtaggaataccaggtacgacgtcactgcaaaatctagttttgtatgtggtatagtacgaggtaaatcattggataaaacgtctctggttgaaatgatgtgggatctcaagaagaaaggattaatatattctatggaatttaccaatctattgagcaagaataccttttatctgttcacatttactatctacactgatgaagtatacgattatctaaacactaataaacttttttctgcaaaatgtttagtcgtgtctacaaaaggagatgtggaaaatttttcatctctaaaaaaagatgtggtcattagagtttga

SEQ ID NO: 258 - DNA, 336 bp, synthetic construct
  source 1..336: mol_type = other DNA
atggcatctttattatatcttattttatttttgttattcgtatgtatttcttattattttacatattatccgaccaataaacttcaggcagctgtaatggaaacagatagagaaaacgctattattagacagcgaaatgatgaaataccgactagaacattagatacagctatatttaccgatgcatcaaccgtcgcgagtgcgcaaatacacctatattataattccaatattggtaaaattataatgtcacttaatggtaaaaaacacacctttaatttatacgatgataacgacatacgaacattacttcctattttactccttagtaaatga

SEQ ID NO: 259 - DNA, 663 bp, synthetic construct
  source 1..663: mol_type = other DNA
atgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataa

SEQ ID NO: 260 - DNA, 375 bp, synthetic construct
  source 1..375: mol_type = other DNA
atgaagaacgtactgattattttcggtaaaccgtattgtagtatttgtgaaaatgtcagtgatgcagtagaagaattaaaatccgagtatgatatactccatgttgatatcttatcattttttttaaaggatggtgattcaagtatgctgggtgacgtaaagcgcggaaccctaataggaaactttgcagcgcatctatctaactacatcgtttccattttcaaatacaatccacagacaaaacaaatggcatttgtggacattaataaatccttggatttcaccaaaaccgataaatcgctggtgaatttggaaattctaaaatccgaaatagaaaaagcaaattatggagtttggccaccggttaccgaataa

SEQ ID NO: 261 - DNA, 1305 bp, synthetic construct
  source 1..1305: mol_type = other DNA
atgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactag

SEQ ID NO: 262 - DNA, 192 bp, synthetic construct
  source 1..192: mol_type = other DNA
atggtgttccaactcgtgtgctctacatgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaa

SEQ ID NO: 263 - DNA, 498 bp, synthetic construct
  source 1..498: mol_type = other DNA
atggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtga

SEQ ID NO: 264 - DNA, 1116 bp, synthetic construct
  source 1..1116: mol_type = other DNA
atggctgcagaacagcgtcgttctacaatttttgacatagtttcaaaatgtatagtgcaatctgtattaagagatatatctattaattctgaatacatagagtccaaagctaaacaattgtgctattgtccggcatcgaaaaaggaatcggtgattaatggtatctacaattgttgcgagtcaaatatagaaataatggacaaagagcagctattaaaaatattggacaatcttcgatgtcattcggctcatgtatgtaacgccacagatttctggagactatataattcgttaaaacggtttactcatactaccgcattctttaatacatgcaagcccactattctagccacgctaaacactttgataaccctgattttatctaacaagttattgtatgcggcagaaatggtagagtatctagagaaccaactagattcatcaaataaatcaatgtctcaagaactagcagaattattggaaatgaaatatgctctcattaatctggtacaatataggattttgccaatgatcatcggtgagcctattatagtagctggattttctggtaaagaaccaatttctgattattctgcagaagtggaaaggctaatggaactaccagttaaaactgatatagtgaataccacatatgacttcttagccagaaaaggtattgatactagcaacaatatagcagaatatatagccggcttgaaaatagaagagattgaaaaggtagaaaaatatttaccagaagttatatctacaattgccaatagtaatataataaaaaataaaaaatctatctttccggccaatatcaacgataaacagatcatggaatgctctagaatgttagacacgagtgagaaatactctaaaggatataaaactgatggagctgtgactagtccattgacgggaaataatacaattacaacatttataccaatttctgcgtccgatatgcaaaagtttaccattttagaatatctttacattatgagagtgatggcaaacaacgttaagaaaaagaacgagggaaaaaacaacggaggagtagttatgcatattaactcaccctttaaggtaatcaatttgccaaaatgttaa

SEQ ID NO: 265 - DNA, 399 bp, synthetic construct
  source 1..399: mol_type = other DNA
atggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataa

SEQ ID NO: 266 - DNA, 219 bp, synthetic construct
  source 1..219: mol_type = other DNA
atggcccaaatgtttacagatccgcccaaggcggcaaaaatatacattaactcatccgtcgagtctacatttatagatacttcttcactgaactctgaaaaatatgccacaatttggcgcagtttatcgatttttatacggatgctcattttaaatttttgtaaattatttaaagttaaatggctgcagaacagcgtcgttctacaatttttgacatag

SEQ ID NO: 267 - DNA, 783 bp, synthetic construct
  source 1..783: mol_type = other DNA
atgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaa

SEQ ID NO: 268 - DNA, 1023 bp, synthetic construct
  source 1..1023: mol_type = other DNA
atgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaa

SEQ ID NO: 269 - DNA, 753 bp, synthetic construct
  source 1..753: mol_type = other DNA
atgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactga

SEQ ID NO: 270 - DNA, 264 bp, synthetic construct
  source 1..264: mol_type = other DNA
atggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataa

SEQ ID NO: 271 - DNA, 1053 bp, synthetic construct
  source 1..1053: mol_type = other DNA
atgaatacccgtaccgatgttacaaacgataatatagacaaaaatccaaccaaacgaggtgataaaaatataccaggaagaaatgaaagatttaatgaccaaaatagattcaacaacgatataccaaagcctaaaccaagactacagcctaatcagccaccgaaacaagataataaatgcagagaagagaatggagattttatcaatattagattgtgtgcctacgagaaggaatattgcaatgacggatatctatctcctgcctattatatgttaaaacaggtggatgatgaagaaatgagttgctggtcagaactatcgtcgttggtgagatccagaaaggcggtgggatttcctctattaaaggcggctaaacgtatttctcacggatctatgctatattttgaacagttcaaaaacagtaaagttgtgagattaaccccgcaagttaaatgtttaaatgatactgttatttttcaaactgtagttattttatattcaatgtataaacgtggcatatattctaacgaattttgttttgatctggtttctattcccagaacgaacattgttttttctgttaatcaattaatgtttaacatttgtacagacatattggtagttctatctatttgcggcaaccggctctatagaacaaatctaccacagtcgtgttacttaaatttcatacacggccatgagacaatagcccgtagaggatatgaacactccaattactttttcgagtggttgataaaaaatcacatatcgctattgaccaagcaaacgatggatattctcaaggtaaagaaaaagtatgctataggagcaccagtaaataggttgttagaacctggtacactggtatatgtgcccaaagaagattattactttataggcatatcactcaccgatgtgtcaattagcgataatgtcagagtattattttccacagatggaatagtgttagaaatagaagactttaatatcaagcatttatttatggcaggtgagatgtttgttagaagtcagtctagtactattatagtataa

SEQ ID NO: 272 - DNA, 756 bp, synthetic construct
  source 1..756: mol_type = other DNA
atgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattga

SEQ ID NO: 273 - DNA, 387 bp, synthetic construct
  source 1..387: mol_type = other DNA
atggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatga

SEQ ID NO: 274 - DNA, 126 bp, synthetic construct
  source 1..126: mol_type = other DNA
atgaatcatcatctgcgaagaacatcgttaagagatactggttgtgatccatttattgatcgcaaaagctttgcacaatctttatacactatcggtttactatttattgataacgcagatgtttga

SEQ ID NO: 275 - DNA, 462 bp, synthetic construct
  source 1..462: mol_type = other DNA
atggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagtcgaataaagtgaacaataattaa

SEQ ID NO: 276 - DNA, 156 bp, synthetic construct
  source 1..156: mol_type = other DNA
atgtatctaataggatctattgcggtggtagctagagaggattcttttttgaatcgcatcaaactaatcacaaagtcgaacaaatatcctttattaagtttgacccttccatctgtaacaatagggaccttgttaaacagttttttaaaatcttga

SEQ ID NO: 277 - DNA, 1002 bp, synthetic construct
  source 1..1002: mol_type = other DNA
atggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatag

SEQ ID NO: 278 - DNA, 558 bp, synthetic construct
  source 1..558: mol_type = other DNA
atgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaa

SEQ ID NO: 279 - DNA, 402 bp, synthetic construct
  source 1..402: mol_type = other DNA
atgacggacgaacaaatttatgcattctgtgatgctaacaaagacgatatacgatgtaaatgtatttatcctgataaaagcatagtacggataggaatagatacaagattaccctattattgttggtacgagccatgtaaacgaagcgatgcgttgttaccagcctctttaaaaaaaaatataacaaaatgcaatgtatcggattgtaccatttcattgggaaacgtttccattacagatagtaaattagatgtaaataatgtttgtgattccaaacgagtagctaccgagaatatagctgtccgctatttaaatcaggaaattagataccctattatagatatcaaatggcttccgattggattactagcgttagctattttaatattagcatttttctaa

SEQ ID NO: 280 - DNA, 3861 bp, synthetic construct
  source 1..3861: mol_type = other DNA
atggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaa

SEQ ID NO: 281 - DNA, 216 bp, synthetic construct
  source 1..216: mol_type = other DNA
atgaatgtttccataccccattcctttacaatgacgctaaaggagataaatcgttcaatcatatattcgacgactaattcggtaatttctgctctcttgatgtataatctattgactattatatctactacatacctatctgtttcttttcgaagagtgatgtctggatttaattctcccaaacatacaaattcgaaattaatcttaacagattga

SEQ ID NO: 282 - DNA, 516 bp, synthetic construct
  source 1..516: mol_type = other DNA
atggataagaaaagtttgtataaatacttactactacgttcaactggagatatgcacagagccaaatctcccactataatgacaagggtaaccaataatgtgtatttgggaaattataaaaatgctatggatgcaccatcatctgaagttaagttcaaatatgttttaaatttgacgatggataaatatacattacctaactctaatattaatattattcatataccgttggtagatgatacaactaccgatattagtaaatattttgacgacgtaaccgcctttttatctaaatgtgatcaacgaaacgagcccgtgttggttcattgtgctgcgggagtaaatagaagcggggctatgattttggcatatctaatgtctaaaaataaggagtcattgcctatgctatattttttatacgtgtatcattctatgagggacttgagaggcgcatttgtggaaaatccatcgtttaaaagacagatcatagaaaaatatgttattgataagaattaa

SEQ ID NO: 283 - DNA, 570 bp, synthetic construct
  source 1..570: mol_type = other DNA
atggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatag

SEQ ID NO: 284 - DNA, 975 bp, synthetic construct
  source 1..975: mol_type = other DNA
atggcggcggcgaaaactcctgttattgttgtgccagttattgatagacttccatcagaaacatttcctaatgttcatgagcatattaatgatcagaagttcgatgatgtaaaggacaacgaagttatgccagaaaaaagaaatgttgtggtagtcaaggatgatccagatcattacaaggattatgcgtttatacagtggactggaggaaacattagaaatgatgacaagtatactcacttcttttcagggttttgtaacactatgtgtacagaggaaacgaaaagaaatatcgctagacatttagccctatgggattctaatttttttaccgagttagaaaataaaaaggtagaatatgtagttattgtagaaaacgataacgttattgaggatattacgtttcttcgtcccgtcttgaaggcaatgcatgacaaaaaaatagatatcctacagatgagagaaattattacaggcaataaagttaaaaccgagcttgtaatggacaaaaatcatgccatattcacatatacaggagggtatgatgttagcttatcagcctatattattagagttactacggcgctgaacatcgtagatgaaattataaagtctggaggtctatcatcgggattttattttgaaatagccagaattgaaaacgaaatgaagatcaataggcagatactggataatgccgccaaatatgtagaacacgatccccgacttgttgcagaacaccgtttcgaaaacatgaaaccgaatttttggtctagaataggaacggcagctactaaacgttatccaggagttatgtacgcgtttactactccactgatttcattttttggattgtttgatattaatgttataggtttgattgtaattttgtttattatgtttatgctcatctttaacgttaaatctaaactgttatggttccttacaggaacattcgttaccgcatttatctaa

SEQ ID NO: 285 - DNA, 2388 bp, synthetic construct
  source 1..2388: mol_type = other DNA
atggactctaaagagactattctaattgagatcattccaaaaataaaagcatatctactagacgcgaatataagtccaaaatcctacgatgactttatttcacgaaataaaaatattttcgttatcaacctttataacgtatcgactatcacagaagaagatatacgattgttatacactacgatagaacagaatattgacgcggatgatcaaacactggttgctattttttcgtatataggatataaatttgaacaggctgttaaagaagagattagtacgagtttatccttcaatgacaagaataccacagatgaaatgacgtataacttgtatgatcttttttttaacacattagacatgtatttacgacaaaagaagatcagtattctggtaaatgatgatgttagaggtgatgtaatcgttagttataaaaatagtgacttagtttcatcatttaatgcggaactagaaccagagattaagaagataccgttcaatatgaaaaatctattaccgtacttggaaaagaatttggaccaattaagattctctaaaaaatatttagactttgcatatttatgtagacacatcggtattcccatttccaaaaaaaagtataatgtgcgatatgtatttctttataaaatagacggattatccattcctattatcattaaggattttttagatgttaagtacgtatatttggaaaatactggaaaaatttataaaaattctttttccgaagaccataacaacagtctatctgattggggtaaagttattatacctctcttaaaggatcgtcatctatatagctacatctttctatctagttatcatttacatagttactatacagatctcatcgcgagagacgagcctgtgtttgtgaaacgcaaaaaactagatattatagagatcgatgaacctgaggcatggaaaagggatgttagagtggaattcgcaccgtgtgagcatcaaattagattgaaggaagctatgaaagttgacgctaactatttcactaaaattaataattttgctaacgaatttatttattatgaagatggtgtggcatattgtagagtgtgtggaataaatatacctatatttaatttagatgccgctgacgtgattaaaaatacagttatcgtttccacgtttaacaagactatatttttgagcgaaccatatagctatttcgttcatagtcagcgctttatctttaatattatcatgtcttttgataatattatgaaatctcaaacttgggtaatgaaatacaacattaaccgactaattcttaactttcttattgatataaactctagacgtcaggaatacgaaaaaaagttttcttctgaaattaagagaggtctgttctttcttcgtttgtctgcaaacttattcgaaagtcaagtatcgtctacagagttattttatgtttccaaaatgcttaatttgaactatatagttgcgttagtaatcattcttaacagtagtgcggactttatagtttcctatatgacatccaagaacaaaacggtagaagaatccactcttaaatacgccatctccgtggttatatacgattttttggttaagactagaatttgcgagaagggatcgttggatactatagttttatttaccgatgtatacacatctataatgccggaggaattggatttacattttcagagaatcacattagaacttagaaaactagtatccattcagagatcggcgttagaacccaattacgatgtagaaagtcgcggcgaagagcttccgctatctgcattaaagtttttcgatacaagcaccattatagttaaaacaatggctccagtacatacatacatcgaacaaaaaattgttgcacctactccatcggtcgaaccaactgatgcatctcttaaaaacttcaaagagctaacgtgtgacgaagatattaagattttgattagagttcatgatactaatgctacaaaattagtcatttttccatcacatctaaaaatagaaattgagagaaaaaaactaattataccgctaaagagtttatatattaccaatactctcaaatattattattctaactcctatttatacgttttcagattcggagatcctatgccattcgaagaagaactcatagatcacgaacatgtgcaatacaaaataaattgttacaatattctaagatatcatttattgccagacagtgacgtgtttgtatattttagtaattcattaaacagagaagcattggaatacgcattttatatctttttgtcgaaatatgtaaatgtgaaacaatggatagacgaaaatataactcgtattaaagagttgtatatgattaatttcaataactaa

SEQ ID NO: 286 - DNA, 177 bp, synthetic construct
  source 1..177: mol_type = other DNA
atgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataa

SEQ ID NO: 287 - DNA, 612 bp, synthetic construct
  source 1..612: mol_type = other DNA
atggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaa

SEQ ID NO: 288 - DNA, 945 bp, synthetic construct
  source 1..945: mol_type = other DNA
atgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatga

SEQ ID NO: 289 - DNA, 183 bp, synthetic construct
  source 1..183: mol_type = other DNA
atggtattgtttggatggcgtttaaatatagacattatcaatgccataatatctaatgtgcttagctccccaaagaaagcggtcattgcgagagatttcatacgcttatccatttccatttatcggtcttgtaattatttgtgtaaagatctatatcatccatccgtagatgatttaacgtga

SEQ ID NO: 290 - DNA, 441 bp, synthetic construct
  source 1..441: mol_type = other DNA
atggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaa

SEQ ID NO: 291 - DNA, 2535 bp, synthetic construct
  source 1..2535: mol_type = other DNA
atggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagttgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaa

SEQ ID NO: 292 - DNA, 129 bp, synthetic construct
  source 1..129: mol_type = other DNA
atgcttgttgagactatcgacagaggaacgtcatatatttttggattacaagaaatatggatcctctatccgactagaattagtcaatcttattcaagcaaaaacaaaaaactttacgatagactttaa

SEQ ID NO: 293 - DNA, 162 bp, synthetic construct
  source 1..162: mol_type = other DNA
atgtctcggatgaaaagaataatggatagcaaactgccagtcgatgatattaaactttccaaaatagaatacttctctgacactagagacaaatgtatcggatcgaatagtttcctgaatgtagtcaaatttgtagtacttggttttaattccagagtttaa

SEQ ID NO: 294 - DNA, 255 bp, synthetic construct
  source 1..255: mol_type = other DNA
atggctcctctatttagttcgaaaaagttttttgtagacggtctatcttccattgtagatgcgccattaataaactttttacttcgttctataattgtagcgaaatcaacgttatctacaagaacaaatccgtattcgttaaacactctgactatatcgttctttttgataatgtattcagtcattggagtagacattgttgatggattatataccactattctatcatcagctattttttctacagacatatag

SEQ ID NO: 295 - DNA, 441 bp, synthetic construct
  source 1..441: mol_type = other DNA
atgtccatcaatatcgatataaaaaaaataactgatttactcaacagtagtattttattcccagatgatgtgcaagaacttcttcgagagaaatatatagtattagaaagaaaatcaaatggtacacctacagtagctcacatctataagacaatggctagatttgataataagagtatatatagaatcgccaagtttttatttatgaacaggccagatgttatcaaacttttatttttagaagacgtagaacctctgttacccgacaaaagtattaatatatctattaacaatacagagtatccacagttggaaggtcctataggaacaaaaatcgctctattggaattatttaatgcatttagaacggggatatcagaacccataccatattattatttaccgcttagaaaagacataaacaacatagtaactaagtaa

SEQ ID NO: 296 - DNA, 243 bp, synthetic construct
  source 1..243: mol_type = other DNA
atgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatag

SEQ ID NO: 297 - DNA, 714 bp, synthetic construct
  source 1..714: mol_type = other DNA
atggacatttttatagttaaggataataagtatcccaaagtagataacgacgataacgaagtatttatacttttaggaaatcacaatgactttatcagatcaaaattaacaaaattaaaggagcatgtatttttttctgaatatattgtgactccagataaatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataa

SEQ ID NO: 298 - DNA, 657 bp, synthetic construct
  source 1..657: mol_type = other DNA
atgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaa

SEQ ID NO: 299 - DNA, 210 bp, synthetic construct
  source 1..210: mol_type = other DNA
atgaaaattctgactatagagtatgcttcctcatccctaagactttcgaatagtgtacattctggattattctcaatatatctttctaactcgtcgcatttaaatgcttctacaaatcttggatcttcattttgtctgcacgctgacgggacacctatagtcttaagaacaaagataacatcattacctctaatagccgcatccatttag

SEQ ID NO: 300 - DNA, 2358 bp, synthetic construct
  source 1..2358: mol_type = other DNA
atggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttagatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaa

SEQ ID NO: 301 - DNA, 171 bp, synthetic construct
  source 1..171: mol_type = other DNA
atgaccagtggtaccgttgtaaaattattttcatcgagatcattaaagtttattatagaattaatgaatatttttgaaactctttttatagcgtcttcgaatgaaataaaccctggttcccataacttatcaggaactaaatcctccaatcgttgttgtagagaaaagtaa

SEQ ID NO: 302 - DNA, 219 bp, synthetic construct
  source 1..219: mol_type = other DNA
atgattgtcgcatggtttctattattaattttattggagaaacacggtcttccaatgacacaaggttctgtcaactttttaatattgtcagatctaattttctttgatccactacaggcaaaatcaggtagttcgctacagaatacagatcttttcaaatgcatgttagcgataaatggattaggtcctttatccaatacatctgttaaaattgtttga

SEQ ID NO: 303 - DNA, 243 bp, synthetic construct
  source 1..243: mol_type = other DNA
atgaatatatattgcagatattcatcactaacattggcaaatttcttatgtctattgatgaagctctctatatcgtgtccaaatagtctagaattaaaatacttggatattttctgttggaaagtagtcaacggaagagtgaccacattatcgtacaatatatatccctttttggagaggtccgtcattaatggaatatgctttacagagctagatactaacagagtacctattttgagatag

SEQ ID NO: 304 - DNA, 1914 bp, synthetic construct
  source 1..1914: mol_type = other DNA
atgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataa

SEQ ID NO: 305 - DNA, 192 bp, synthetic construct
  source 1..192: mol_type = other DNA
atgatatatttaattaccaatccaccatatgtagaattagaaaagtatataaaatgttttccgttgagtgtctgtatccgattaataaagtatttaaatttggaactaatgtttaacgttaccaattcttctccgtataacacgccattatttattttcagatttgggtacaattccttatcctgttcctga

SEQ ID NO: 306 - DNA, 168 bp, synthetic construct
  source 1..168: mol_type = other DNA
atgtggattagttccctgagaaccattatattcagaatatccattactgagcatgatatatttaattaccaatccaccatatgtagaattagaaaagtatataaaatgttttccgttgagtgtctgtatccgattaataaagtatttaaatttggaactaatgtttaa

SEQ ID NO: 307 - DNA, 135 bp, synthetic construct
  source 1..135: mol_type = other DNA
atgtctaacgtcagctcgtgtggttccaatgtaactggaaggtatccattggtaacaaagctcgacatttatttctttatatatttcatcagttttatggagaagataccacgttatattctttacgaaagttaa

SEQ ID NO: 308 - DNA, 486 bp, synthetic construct
  source 1..486: mol_type = other DNA
atgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataa

SEQ ID NO: 309 - DNA, 915 bp, synthetic construct
  source 1..915: mol_type = other DNA
atgccgcaacaactatctcctattaatatagaaactaaaaaagcaatttctaacgcgcgattgaagccgttagacatacattataatgagtcgaaaccaaccactatccagaacactggaaaactagtaaggattaattttaaaggaggatatataagtggagggtttctccccaatgaatatgtgttatcatcactacatatatattggggaaaggaagacgattatggatccaatcacttgatagatgtgtacaaatactctggagagattaatcttgttcattggaataaaaaaaaatatagttcttatgaagaggcaaaaaaacacgatgatggacttatcattatttctatattcttacaagtattggatcataaaaatgtatattttcaaaagatagttaatcaattggattccattagatccgccaatacgtctgcaccgtttgattcagtattttatctagacaatttgctgcctagtaagttggattattttacatatctaggaacaactatcaaccactctgcagacgctgtatggataatttttccaacgccaataaacattcattctgatcaactatctaaattcagaacactattgtcgtcgtctaatcatgatggaaaaccgcattatataacagagaactatagaaatccgtataaattgaacgacgacacgcaagtatattattctggggagattatacgagcagcaactacctctccagcgcgcgagaactattttatgagatggttgtccgatttgagagagacatgtttttcatattatcaaaaatatatcgaagagaataaaacattcgcaattattgccatagtattcgtgtttatacttaccgctattctcttttttatgagtcgacgatattcgcgagaaaaacaaaactag

SEQ ID NO: 310 - DNA, 156 bp, synthetic construct
  source 1..156: mol_type = other DNA
atgtgtacaaatactctggagagattaatcttgttcattggaataaaaaaaaatatagttcttatgaagaggcaaaaaaacacgatgatggacttatcattatttctatattcttacaagtattggatcataaaaatgtatattttcaaaagatag

SEQ ID NO: 311 - DNA, 642 bp, synthetic construct
  source 1..642: mol_type = other DNA
atgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatga

SEQ ID NO: 312 - DNA, 747 bp, synthetic construct
  source 1..747: mol_type = other DNA
atgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattga

SEQ ID NO: 313 - DNA, 1896 bp, synthetic construct
  source 1..1896: mol_type = other DNA
atgagtaaatcacacgcggcctatatcgattatgcattgcgcagaactactaatatgcccgttgaaatgatggggtcggacgtagtacgcctcaaggattatcaacattttgtagcaagagttttcttaggattagacagtatgcattctcttttattgttccatgaaacgggtgtcggtaaaacaatgactactgtatatattctcaaacatcttaaggatatttatacgaattgggctattatcttattggtgaaaaaggctttgatagaagatccttggatgaacactatactcagatacgctccagagataacgaaggattgtatttttattaattacgatgatcaaaattttagaaataaattttttactaatatcaaaactattaattccaagagtagaatatgcgtcattattgatgaatgtcataacttcatttctaaatcattaatcaaagaagatggtaagatccgtcctactcgttcagtatataattttttatctaagaccatcgcattaaaaaaccataagatgatttgtttatcggctacacctatcgttaatagtgtgcaagaattcaccatgttggttaacttactacgaccaggatccttacaacaccaatcgctatttgagaataaacgtctagttgatgagaaagaattagtctccaaactaggaggcctatgttcgtacatagttaataacgagttttctatttttgatgacgtagaagggtctgcatcattcgctaagaaaacagtattaatgcgatacgttaatatgtcgaaaaagcaagaagaaatttatcaaaaggctaaactcgctgaaataaaaacaggtatatcatcatttagaattctgagacgtatggctactacgtttacgttcgatagctttcctgaaagacaaaatcgtgatccgggcgaatacgcgcaagagatagcaacactatataatgattttaaaaattcattaagagatagagagttttctaaatccgcattagatacctttaaaaagggagaactattgaaaggggatgctagtgcggctgatatctctctatttactgaattaaaagagaaaagcgtcaaatttatagatgtatgtttgggaatattagcatcccatggtaaatgtctagtctttgaaccatttgttaatcagtcaggaatagaaatcttattactatatttcaaagtctttggtatctctaatatagagttctcatctagaacaaaagatactagaatcaaggcggtggctgagtttaaccaagaatcaaacactaacggagaatgcattaaaacatgcgtattctcttctagtggaggcgagggtattagttttttctcaattaatgatatcttcattttagatatgacatggaacgaggcgtctcttcgtcagatagtaggaagagccattcgtctcaatagtcacgttcttactcctccagaacgtagatatgtaaacgtgcactttataatggctagattatctaatggtatgcctactgtagacgaagacctatttgaaatcattcaaagcaaatcaaaagaatttgtccaattgtttagagtgtttaaacatacatcattagaatggattcatgctaatgaaaaagacttctcaccgatcgacaatgagtccggttggaaaaccttggtttcaagagccatcgatctatcgtctaaaaaaaatattaccaataaactaattgagggtactaatatttggtattccaattctaatagattaatgtcaataaatagaggatttaaaggcgtagatggtcgagtatacgatgtagacggtaactatctacatgatatgccggacaatcccgttataaaaatacacgatggtaaattaatttatattttctaa

SEQ ID NO: 314 - DNA, 210 bp, synthetic construct
  source 1..210: mol_type = other DNA
atgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactga

SEQ ID NO: 315 - DNA, 273 bp, synthetic construct
  source 1..273: mol_type = other DNA
atgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatga

SEQ ID NO: 316 - DNA, 186 bp, synthetic construct
  source 1..186: mol_type = other DNA
atgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataa

SEQ ID NO: 317 - DNA, 864 bp, synthetic construct
  source 1..864: mol_type = other DNA
atggatgaaattgtaaaaaatatccgggagggaacgcatgtccttcttccattttatgaaacattgccagaacttaatctgtctctaggtaaaagcccattacctagtctggaatacggagctaattactttcttcagatttctagagttaatgatctaaatagaatgccgaccgacatgttaaaactttttacacatgatatcatgttaccagaaagcgatctagataaagtctatgaaattttaaagattaatagcgtaaagtattatgggaggagtactaaagcggacgccgtagttgccgacctcagcgcacgcaataaactgttcaaacgtgaacgagatgctattaaatctaataatcatctcactgaaaacaatctatacattagcgattataagatgttaaccttcgacgtgtttcgaccattatttgattttgtaaacgaaaaatattgtattattaaacttccaactttattcggtagaggtgtaatcgatactatgagaatatattgtagtctctttaaaaatgttagactgctaaaatgcgtaagcgatagctggttgaaagatagcgccattatggtggctagtgatgtttgtaaaaaaaatttggatttatttatgtctcatgttaagtccgtcactaagtcttcttcttggaaggatgtgaacagtgttcaatttagtattttaaacaatccagtggatacggaattcattaataagttcttagagttttcgaatagagtatacgaagctctctattacgttcactcgttgctttattctagtatgacttctgattcaaaaagtatcgaaaacaaacatcagagaagactagttaaactactgctgtga

SEQ ID NO: 318 - DNA, 189 bp, synthetic construct
  source 1..189: mol_type = other DNA
atggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataa

SEQ ID NO: 319 - DNA, 219 bp, synthetic construct
  source 1..219: mol_type = other DNA
atgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatag

SEQ ID NO: 320 - DNA, 1656 bp, synthetic construct
  source 1..1656: mol_type = other DNA
atgaataatactatcattaattctttgatcggtggggatgactctattaaacggtctaatgtcttcgcagtcgatagtcaaattccaactttatatatgccgcaatatatttctctatccggagttatgacaaacgatggtccagacaatcaggctatcgctagcttcgaaattagggatcagtatattactgcgcttaatcatttggttctgagtttggaacttccagaagttaaaggtatgggaagattcggttacgtaccatatgttggatataaatgtattaatcacgtatctatctcttcgtgtaacggtgttatttgggaaattgagggcgaagaattatataataattgtatcaataatacaattgctttgaaacactctggatattctagtgaacttaatgatatttctattggcctaactcctaatgacactattaaagaaccatctacagtatacgtttatattaaaactccgtttgatgtggaagatacattcagcagtcttaaactatccgattcaaaaattaccgtaacggtaaccttcaatccagtatccgatatcgttattcgtgactcttcgttcgactttgaaacgttcaacaaagaatttgtttatgttcctgaattgagctttattggatatatggttaagaatgtacaaattaaaccatcgtttatagagaaacctaggagagtaataggtcaaataaaccaaccaacggcgactgtaactgaagttcatgcggcaacatcgctctctgtttatactaaaccttattatggaaatacggataataaatttatttcgtatccagggtactcacaagatgaaaaagattatatagatgcatatgtgagtagattgttggatgatctagttattgttagtgatggcccaccgactggttatccggagtctgccgagattgttgaggttccagaagatggtatcgtttctattcaagatgctgatgtgtatgtaaaaattgataatgttcctgataatatgagtgtttatcttcatactaatctgctaatgtttggaacacgaaaaaattcttttatatataacatttctaaaaagttttccgccattactggaacatatagtgatgccactaagagaacaatctttgctcacatatcacatagtatcaacatcatcgatacatctattcctgtaagtctttggactagtcaacgtaacgtctataacggagataatagatcagccgaatcaaaggccaaggatttgttcattaacgatcccttcatcaagggaatagattttaagaataagaccgatattatttctagactagaagttagatttggaaatgatgttctatattcagagaacggacccatctcgagaatttataatgaactactgacaaaaagcaataatggaacaagaaccctaacttttaactttacaccaaagatattctttaggccgacaactattacggctaatgtatctagggggaaagataaactatctgttcgagtagtttattccaccatggatgtcaaccatccaatctattatgtacaaaaacaattggtagttgtatgtaatgacctgtataaggtatcttacgatcaaggggtaagtattaccaagattatgggagataataactaa

SEQ ID NO: 321 - DNA, 225 bp, synthetic construct
  source 1..225: mol_type = other DNA
atgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttga

SEQ ID NO: 322 - DNA, 453 bp, synthetic construct
  source 1..453: mol_type = other DNA
atggctaagcgagtaagccttccagatgtggttatttcagcacctaaagcagtctttaagcccgctaaagaagaagcactcgcttgtatactaccaaagtattataaatctatggcagatgtgtctattaagacaaatagtgtaattgataagtgttggttttgtaatcaagatttggtttttaaacctattagtattgagacattcaagggtggtgaagttgggtatttctgttctaaaatatgtagggattcgttggcgtctatggttaagtctcacgtagctcttagagaagaaccaaaaatttctttgttgcctttagtattctatgaagataaggaaaaggttataaatacaataaacttactaagagataaagacggcgtttacggaagctgttactttaaggaaaactcacaaattatagatatttctctacggagtttattgtaa

SEQ ID NO: 323 - DNA, 675 bp, synthetic construct
  source 1..675: mol_type = other DNA
atgaatctacgattatgtagcggttgtagacacaacggtatagtatctgaacaaggatatgaatattgtattttttgcgagtcggtatttcaaaaatgtacaaaggtacaaaaaaagtcaaacttccatgtgtctaataaacttattcatttgagaaatgtattgcggagattattgtctcatcaatgttctggagaaattatctcggaactcttggatatcatggaaaaaaatcaaatatccacggatgatgtagatgcaaattttgtatctagttttcttaaggctaacgagagaataaataaaaaggattataagttagtctttgaaataatcaatcaagtaaaagatgagaaactgaatctgagtacagaaaagattaatgaagtagtagaaatatttaagcacttggtattcttttgccaagaaaacactccttctaagacaattaattattcattctttttggataaaatattcgatatcacttctgtaactaaaaatctaaaacctcaaactgttaaaaattatacgaaaaataatagtaaccaattagtatgggaaaactttttagcacatatgagatctaaaaaacgtgtaactatggtagaggattatggacacgagtatgtttttgtagatgagaggttttctacttgctcattagaagtataa

SEQ ID NO: 324 - DNA, 231 bp, synthetic construct
  source 1..231: mol_type = other DNA
atgagttggtacgaaaaatataacattgtactgaatccgcctaagcggtgttcttttgcatgtgcggataatttaactactatattggcggaagacggtaacaatattagggcgatactttattcacagcccaaaaaactaaaaatattacaggattttctggcaacgtctagaaataaaatgtttttatataaaatattggacgacgagatacgtagagtgttaacatga

SEQ ID NO: 325 - DNA, 1935 bp, synthetic construct
  source 1..1935: mol_type = other DNA
atggaagccgtggtcaatagcgatgtttttttaacatctaacgcaggactaaaatctagttatactaatcaaactctttctttggtagatgaagatcatattcacacttctgataaatctttgtcttgtagtgtatgcaattcattatccaaaattgtagacgatgactttatatctgcaggggctagaaatcaacgtaccaaacctaaacgtgcaggaaataatcaatctcaacagcctatcaaaaaggattgtatggtttccatcgacgaagtagcatctacacatgattggagtacgagattgagaaatgatgggaatgcaattgctaaatatctaactactaacaagtatgacacatctaactttactattcaggatatgcttaacattatgaataaactaaatattgtcagaacaaatagaaacgagctatttcaactccttacccatgtaaagagcacattgaacaatgctagtgtttctgtgaaatgtactcatcctttagtacttattcattctcgagctagtcctagaatcggtgaccaactcaaagagttagataaaatatactctccatctaatcatcatattcttctgtcgactacacgattccaatccatgcattttaccgatatgtctagttcacaagatttgtcttttatttatagaaaaccagaaactaattactatattcatcctattctgatggcactattcggtattaaacttcctgcgctcgagaacgcgtatgtacatggagacacctatagcctaatccagcaactttatgaatttagaaaagtaaagtcttataattatatgttgttggttaatcgtcttacggaggataatccgatagtgattacaggtgtatcagatctaatttccacagagattcagagagcaaacatgcataccatgattagaaaagcaattatgaacattagaatgggaattttttattgtaacgatgatgatgcggtagatccccatctaatgaagattattcatactggatgctctcaagttatgacagatgaggaacagatattggcttctattttgtctatagttggatttagacctacgttggtttctgtggctagacctataaacggcatcagttacgatatgaaacttcaggcggcaccatacatagttgttaatcctatgaagatgatcacaacatccgacagtccgatttctatcaattccaaggatatttattctatggcattcgatggcaatagtggaagagtggtgttcgctcctcctaacataggatatggaagatgttctggagttacacacattgatccattgggaactaatgtgatgggtagtgctgttcattcccctgttatcgttaatggagcaatgatgttttatgtagaacgacgtcagaataagaatatgtttggtggagaatgttacaccggctttagatctctaatagatgatactccgattgacgtatcaccagaaatcatgctaaacggtatcatgtataggttaaagtccgcagtttgttacaaactcggagaccaattctttgattgtggatcgtctgatatcttcttgaagggacattatacgattctatttacagaaaatggaccctggatgtacgatcctctttctgttttcaatccgggagctagaaatgctagattgatgcgagctctcaaaaaccagtacaagaaattatcaatggattcagacgatggtttttatgaatggttgaatggcgacggttcagtatttgctgcctcaaaacagcaaatgttgatgaatcacgttgctaactttgacgacgatcttctaactatggaagaagccatgtcgatgatttcgagacattgttgtatcttaatttatgcacaggattatgatcaatatattagcgctagacatattacagaactattttag

SEQ ID NO: 326 - DNA, 360 bp, synthetic construct
  source 1..360: mol_type = other DNA
atgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattag

SEQ ID NO: 327 - DNA, 852 bp, synthetic construct
  source 1..852: mol_type = other DNA
atggacttctttaacaagttctcacaggggctggcagaatcctctacaccaaagtcgtcaatctattattctgaaaaaaaggatccggatacgaaaaaggatgaagcgattgaaataggactaaagtctcaagagtcgtattatcaaagacagttgcgagaacaactagctagagataatatgatggccgccagcagacagcctatccaaccgctacaaccaactattcatataactccacagccggttccggttccgacacctacatcggctcctattcttctacctagtagtactgctcctacaccaaaaccacgacaacaaactaatacatcatctgatatgtctaatctttttgattggctgtctgcagatactgatgcgccggcgagttcactccttccagcgttgacgccgagcaatgctgttcaggatattatctctaaatttaataaagatcaaaagacgacgacaccgccatctacccaaccttctcagacgttaccaacaactacatgtacacaacaatcggatggaagtatttcttgtactactccaacggttacacctcctcaacctcctattgtggccactgtatgtactcctacacctactggtggtacagtatgtacaacagcacaacaaaatccaaatccaggagcagcatctcaacaaaatctagacgatatggcccttaaggatctcatgtcgagtgttgaaaaagatatgcaccaacttcaggccgaaacaaacgatctggtgacgaacgtatatgatgcaagggagtatacgcgtagggcaatagatcaaattctacaactagtcaaaggttttgaacgattccaaaagtaa

SEQ ID NO: 328 - DNA, 495 bp, synthetic construct
  source 1..495: mol_type = other DNA
atggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattag

SEQ ID NO: 329 - DNA, 1119 bp, synthetic construct
  source 1..1119: mol_type = other DNA
atggacaaacttagagttctatacgatgagttcgtcaccattagtaaagataatcttgaacgcgagactggtcttagcgcatcagatgttgatatggattttgatttaaacatttttatgacgttggttccagtcttggagaaaaaggtatgcgctattacaccaactatagaagatgataaaatcgtaactatgatgaaatattgtagttatcagagtttttcattctggttccttaaatctggtgccgttgtgaaatcggtatataataaactagatgatgtgaaaaaggaaaagtttgtagccacatttagagacatgttgcttaatgtacaaactctaatctctcttaactctatgtatactagactgcgtcaagataccgaagatatagtatccgattccaaaaaaataatggagatcgtttcccatttgagagcgtcgactacagagaacgcggcgtatcaagttctccaacaaaacaatagttttatcatatctacactaaataaaatcttatctgatgaaaactatctcttgaaaattattgcagtattcgactctaaactaatttctgaaaaggagacattgaatgaatacaaacaattgtacaccatttcttctgaaagtttggtatacggaatcagatgcgttagtaatctggatatatcatctgttcaactgagtaacaataaatacgttctctttgttaagaaaatgctacctaaaatcatactgtttcagaataacgacatcaatgcacaacaattcgctaatgttatttctaaaatttatacgttgatttatagacaattgacgtcgaatgtcgatgttggatgtctattgacagatacgatagaatctgccaaaactaaaatatctgtagaaaaaattaaacagacgggtattaataatgttcaaagtcttatcaaattcatatcggataacaagaaagaatataagacaataatctctgaagaatatctatcgaaggaagatagaatcattactattttgcaagatatcgttaatgaacacgatataaagtacgacaataaattgctgaacatgcgagacttgattgtgacatttagagaacgatattcgtataaattctaa

SEQ ID NO: 330 - DNA, 108 bp, synthetic construct
  source 1..108: mol_type = other DNA
atgtctctaaatgtggctacaaacttttcctttttcacatcatctagtttattatataccgatttcacaacggcaccagatttaaggaaccagaatgaaaaactctga

SEQ ID NO: 331 - DNA, 2133 bp, synthetic construct
  source 1..2133: mol_type = other DNA
atgcgatatatagtaagtccgcaattggtattacaggtgggtaaggggcaggaggtagaacgagccctatatctcactccatatgattacatagatgagaagtcgcccatatattattttttacgaagtcatttaaatatacaacagccggaaatagttaagagacatattctattgacgcttcgaatgactcaattaaagggatatttaggaaatttgttagatattaaggacgatattattatctattctcataagaataatttggaatatagttacgttgataatactatttttaatcccttcgtatacacgcagaaaaaaaccctactaaaaaacgatagctttttatacaatgtatatcctggagcgtgtgactttttggttatctgggtggccagagcgtgcgatacatctattccggaatttggatcgtacgaagatgtagataataatattatcaagtttgaaacaatgttgatggaagtatttccacaactagatttggacattactatagaatcaaagtttaacaatatatttcgtaccaatctaaaactaactgggttaaaaaagatcattcagcgagttcaagacttggacattaattataagtcgttgttatctagatacgatgaacactttattaatatgaccggtaatcattttattctaaacgatgaacagttaaatctctccatttgggacttggatggtacattagcgttatctagcgacggcgataccgtgatgattaataacgtaaaactatttacagatcttgtgtccgatatagatacacaaatggaacgcatcaagggagatataacgtataaggtacatttggcgactcctatcaattctagaataaaattggatatcgagactagcttcatttttatagagacggcgactaataatattttactatcctcggataaaaaaatatctatcattttggccaaaaaccatatatctattaaagtgaaaaaccatattcctaacatagaaaaatattttacatttttagttattgccattaatgccatgtttaatagcgttcaaaagtctgctgattttaccaaagtggaaactgtttactggtctaggatatgccaaaatacaaagaataagaatagaaaacccatcattattaattatctagatcctggaatgaaaaaaatcagtaacaacttttacagatccgatgagaaagaagtctttattaatgataacggcataatgtttacgtgcatggatcctttggggaaatataataaggtgggatttcttaatatatttcatgatatgcggaaatattgtatcccttgttgttttctacatgatcaatctcatagaagcacattttcatcgtgtgttcatcaaattgacgttgagaaaaagatagtaagtccgtatatccttaattttggtaaagtcgtaacagaatccaaaatgtcatttctccctattatttttgacgccttcttaaatgatggaatgactgctaatatggaacaagataataaacggctaaaggaaactagtggatatcatatagttagatgttgtgctggtgatgatatagttcgtttacgaactacatctgatattattcagtttgtaaacgaggataaaaatattcttatagttaacgacatggtatattttccaatgaacgcgtccgatataggaaagaaaatacatatactcattcaagaaatagttcatgaggtaatgatagtaaaaaagaaagagtctagtgataaaatcgattttttcccacccaactataagttattgaaggatctatttccaaaacaaactattcaaactcctattcaatctgacgcgggaatggtgttaacaaccgatggattctacatagatggaaaactttttaacgaagatctgtcgtctaaatacgttacatttacaaaaaatgttattgcgtctgatgccgtagctaaatatttttctcctttgtttaaatacgttatttcagaagctaaagatagatttatcaaaacgtggatgattaatattatgatacatatgaacgtagatcctaataatataataccgacgttagaaaaatactatcccaactctggaagagcacaaataaattaa

SEQ ID NO: 332 - DNA, 387 bp, synthetic construct
  source 1..387: mol_type = other DNA
atggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatga

SEQ ID NO: 333 - DNA, 306 bp, synthetic construct
  source 1..306: mol_type = other DNA
atgatcttttttaacccagttagttttagattggtacgaaatatattgttaaactttgattctatagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaa

SEQ ID NO: 334 - DNA, 867 bp, synthetic construct
  source 1..867: mol_type = other DNA
atgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttag

SEQ ID NO: 335 - DNA, 147 bp, synthetic construct
  source 1..147: mol_type = other DNA
atgttcatctcgaatagccagagctactgtagagtaatacggttcaaaatcataaacgtgatagtttccaaactggtatccgagtttttcttggatgatggatacttgagagttgaatttaaatttcttactatgttcattatatag

SEQ ID NO: 336 - DNA, 300 bp, synthetic construct
  source 1..300: mol_type = other DNA
atgtcatgttatacagctatattaaaatctgtaggaggactggcgctatttcaagtagccaatggcgccatagatttatgtagacatttctttatgtatttttgtgaacaaaagctacgaccaaattcattttggttcgtcgttgttagagccattgcaagcatgataatgtatttagtattaggcatagcattgctgtatatttctgaacaagataacaagaagaatactaataatgatggtagtaataatgataaacgaaatgagtcgtctataaattctaactccagtcctaagtaa

SEQ ID NO: 337 - DNA, 2676 bp, synthetic construct
  source 1..2676: mol_type = other DNA
atgatgcctattaagtcaatagttactcttgatcaattagaggactctgaatatttatttcgtatagtttctaccgttcttccgcatctatgtctagattacaaagtatgcgacaaactcaaaacaaccttcgttcatccgttcgatatattgcttaataactcattaggatccgtaactaaacaagatgagcttcaggctgctatatccaaattgggcattaattatttaattgatactacttcacgtgaattaaaactgtttaatgttacacttaacgctggaaatatagatattattaataccccaattaacattagttcggaaactaatcctatcattaatactcacagcttttacgatcttccacctttcactcaacaccttcttaatattagattgacggatacagaatacagagctagatttatcggtggttatattaaaccagatggctccgactcaatggatgttctagcagaaaagaaatatccagatcttaactttgataacacttatttgtttaacatcctctataaggatgttattaatgcaccaataaaagaattcaaggcaaaaattgttaacggtgtattaagcagacaagattttgataatcttataggtgttagacaatatataacaatacaagatcgaccccgctttgacgacgcttataacatcgcagatgctgctagacattatggagttaatcttaatacattgccattaccaaacgtcgatctcactactatgccaacatataaacatctcatcatgtttgaacagtacttcatttatacatatgacagagtggatatttattacaatggtaacaaaatgctcttcgatgatgagattataaactttactatttctatgcgatatcaatctcttattcctagactggtagatttctttccagatataccagtaaacaataacatcgtacttcatactcgcgatcctcaaaatgctgcagtgaatgtaaccgtggcgcttccaaacgtgcaatttgtggacataaatagaaacaacaaattctttattaatttctttaacctgttggcgaaggaacaaagatctacggctatcaaagttaccaaatccatgttttgggacggtatggattacgaggaatacaagtctaaaaaccttcaggacatgatgtttataaattctacctgttatgtattcggtctttataatcacaataatactacttattgctctatcctttctgatattatctccgcagagaaaacacctattagagtttgtttgttacccagagtagtcggaggtaagactgttactaatcttatttcagaaactttgaagagtatttcatctatgactatacgagagtttcccaggaaagataaatctatcatgcatataggactttctgagacgggattcatgagattcttccaactactcaggctcatggctgataaacctcatgaaacggctattaaagaggttgttatggcttatgtgggtataaagttgggtgacaaaggtagtccgtactatattagaaaggagtcataccaagactttatctatctgctattcgcatcaatgggctttaaggtgactactagaagatccattatgggaagcaataatatctctatcatcagtattagaccaaaagtaactaaacaatacatcgtcactacattgatgaaaactagttgtagtaaaaacgaggcagaaaaattaattacttcagcgtttgatcttctcaatttcatggtatcagttagtgactttagagattatcagagttacagacagtatagaaactattgtcctagatatttctatgcaggatctcccgaaggagaggaaaccattatctgtgactcggaaccgataagtatcttggatagaattgatactcgtggtatcttttctgcgtatactattaatgaaatgatggacactgatatcttttctccagagaataaggcatttaagaataatctgagtagatttatcgagagtggagatattacaggagaagatattttctgcgcaatgccatacaacatcttagataggattattacaaatgctggtacgtgtaccgtatccataggtgatatgttggataacattacaacccagtcagactgtaatatgactaacgaaatcacagatatgataaacgcctcattgaagaatacaatttctaaagataataatatgctagtcagccaagcattggactctgtagctaatcgttctaaacaaacgattggagacttgaggcaatcatcgtgtaagatggcattgttgtttaaaaatcttgttacatccatctacacaatagaacgtattttcaatgctaaagtaggcgatgatgttaaggcatcgatgttggagaagtataaagtattcacagatatttccatgtcattgtataaagacttgatagctatggagaatctcaaagcgatgctatacattattcgacgaagcggatgcagaatagacgatgcacaaattactactgacgatctagtcaagtcttactcattgatccgtcctaaaattctaagtatgataaactattataatgaaatgagtagaggatactttgaacacatgaaaaaaaatctaaatatgacagatggtgactctgtctcttttgatgatgaataa

SEQ ID NO: 338 - DNA, 501 bp, synthetic construct
  source 1..501: mol_type = other DNA
atggatgtaacaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatag

SEQ ID NO: 339 - DNA, 195 bp, synthetic construct
  source 1..195: mol_type = other DNA
atgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatag

SEQ ID NO: 340 - DNA, 228 bp, synthetic construct
  source 1..228: mol_type = other DNA
atgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacaaactctaataggtgttttctctgcggagataatatcagaaaggatagagcaataa

SEQ ID NO: 341 - DNA, 228 bp, synthetic construct
  source 1..228: mol_type = other DNA
atgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaa

SEQ ID NO: 342 - DNA, 957 bp, synthetic construct
  source 1..957: mol_type = other DNA
atgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaa

SEQ ID NO: 343 - DNA, 579 bp, synthetic construct
  source 1..579: mol_type = other DNA
atggcggataaaaaaaatttagccgttagaagcagttacgatgattatatcgaaacagttaataagattacaccacagcttaaaaatctactagcgcaaatcggtggagatgcagccgtcaaaggaggcaacaataatcttaattctcaaacagatgtgactgccggcgcatgtgatacaaaatcaaagagttcaaaatgtattacatgtaaaccaaaatcaaaatcctcgtcttcttctacatcagcctccaagggctccaaaaatacttctggtgctcctaaacgtagaacaacagttactactacatcgtacaatgcgatggatggtcagattgtccaagctgttactaatgctggtaaaatagtttatggtaccgtcagagacggccaattagaagttcgtggaatggtcggagagatcaatcacgatcttctaggtatcgactcagttaatgctgggaaaaagaaaccatctaaaaagatgcccactaataaaaagattaatatgtcgtccggtatgagacgacaggaacagattaatccagacgattgttgtctggatatgggaatgtattaa

SEQ ID NO: 344 - DNA, 213 bp, synthetic construct
  source 1..213: mol_type = other DNA
atgattggtattcttcttttgatcggtatttgtgtagcagttactgtcgccatcctatactcgatgtataataagatcaagaacttacaaaatctgaatccaagtccgaatttaaattcgcctcctccagaaccaaaaaataccaagtttgtaaataatctggaaaaggatcatattagttcattgtataatctagttaaatcttctgcataa

SEQ ID NO: 345 - DNA, 273 bp, synthetic construct
  source 1..273: mol_type = other DNA
atggacatgatgcttatgattggaaattatttttccggcgtgctaatcgctggaatcattcttttgattctttcgtgtatcttcgcctttattgactttagtaagtctaccagtcccactcgtacatggaaagtattgagtattatggcgtttatacttggtattattatcacagtcggaatgctaatttattctatgtggggaaagcactgcgcaccccacagagttagcggagtcattcacaccaatcatagcgatatttccatgaactaa

SEQ ID NO: 346 - DNA, 162 bp, synthetic construct
  source 1..162: mol_type = other DNA
atgataagtaattacgagccgttgctgctgttagttataacatgctgtgtactactatttaattttaccatatcttcgaaaacaaaaatagatattatttttgcagtacaaactattgtttttatatggtttatattccactttgttcattcggcgatttaa

SEQ ID NO: 347 - DNA, 285 bp, synthetic construct
  source 1..285: mol_type = other DNA
atgttcgtagacgataattcgttgataatttattctacatggcccagtacattgtccgattcatcaggtagagtcatcgttatgccagataatagatcattcacgtttaaggaagggtttaaattagatgaatcgataaaatctatattgttggtaaacccgtcgtctatagatctattaaagattagagtatataaacatcgcataaaatggatgggtgatatattcgtattatttgagcaagaaaatatcccaccaccttttcgtctagtaaatgataagtaa

SEQ ID NO: 348 - DNA, 177 bp, synthetic construct
  source 1..177: mol_type = other DNA
atgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataa

SEQ ID NO: 349 - DNA, 1134 bp, synthetic construct
  source 1..1134: mol_type = other DNA
atgggggcagctgttactcttaatagaatcaaaatagcaccaggaatagcagatatacgagacaaatatatggaattaggttttaattatcctgaatataatagagctgttaagtttgcagaagaaagttatacgtactattatgaaacatctccgggagaaattaaacccaagttttgtttgatagatggtatgtcgatagatcattgtagtagttttatagttcctgaatttgctaaacaatatgtattaattcatggagaaccatgtagttctttcaaatttcgtcctggatcattaatctattatcagaacgaggtaactcctgaatatattaaggatttaaaacacgctactgattatatagcatccgggcaacgatgtcattttataaaaaaggattatctcctgggcgatagtgatagcgtagcaaaatgttgttctaagacaaataccaaacactgtccaaaaatatttaataataattacaagacagaacattgtgacgatttcatgactggattttgtagaaacgatcctggaaaccccaattgtttagaatggttacgtgcaaaacggaaaccggctatgtctacttattccgatatttgctccaaacatatggatgcgagatattgttctgagtttattagaattattcgtcctgattattttacttttggggatacggcattatacgtcttttgtaacgatcataaaggaaatagaaattgttggtgcgcgaattatccaaaatctaattccggagataaatatttaggacctagggtatgttggttacatgagtgcaccgacgaatctagagatagaaaatggttatattataatcaagatgttcaaagaactagatgtaaatacgttgggtgcacgattaacgttaactctttagcgttaaaaaattcccaagcggaacttacgtctaattgtactagaactacgtccgccgttggtgacgtacatccaggagaacctgtagtaaaagataaaataaaactgcctacctggttgggcgcggccataacactggttgtaatatctgttattttctattttatatccatttattcgcgtcctaaaattaaaacaaatgatataaatgttcgtagacgataa

SEQ ID NO: 350 - DNA, 183 bp, synthetic construct
  source 1..183: mol_type = other DNA
atggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttga

SEQ ID NO: 351 - DNA, 159 bp, synthetic construct
  source 1..159: mol_type = other DNA
atgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaa

SEQ ID NO: 352 - DNA, 612 bp, synthetic construct
  source 1..612: mol_type = other DNA
atgagttatttaagatattacaatatgcttgacgacttctctgcgggtgctggagtgcttgataaagatttatttacagaggaacagcagcaatcgtttatgcctaaagatggaggtatgatgcaaaacgattatggaggaatgaatgattatttgggaatcttcaaaaataatgatgttagaacgttactcggtttgattttgttcgtcttggctctatatagccctcctctaatctctatattgatgatatttatctcatcttttctattgcctcttactagcttagttattacctattgcttagtaactcaaatgtatcgtggaggtaatggcaacactgtgggaatgtctattgtgtgtattgtagctgctgtaattattatggcaatcaatgtatttacgaattcacagatatttaatattatttcttacattattttgtttattctgttctttgcatatgtgatgaacatcgaaagacaggactatagaagaagtataaatgtaaccattcctgaacagtatacctgcaacaaaccttatactgcgggaaataaggtagatgttgatataccaacatttaacagtttaaatactgacgattattaa

SEQ ID NO: 353 - DNA, 1482 bp, synthetic construct
  source 1..1482: mol_type = other DNA
atgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatgataaaacgattagatggaccatctaataaatatcatatatatactgagaagttattatctgtagacgagcctagaaatcaacttattcttgataccctggtagaagaattcaagtcaggaactattaatcgcattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaa

SEQ ID NO: 354 - DNA, 189 bp, synthetic construct
  source 1..189: mol_type = other DNA
atgaaatttcctatcatgtactttatttctttgatggatgtgttaggaaatacatataccgtcctatctaatagttctgtttctcgacataccctccctagtaattgctctatttgcatattgttgattactgccgagcaaatgaacaacgaatccaaactaggaatatctaaaccagtaccggaataa

SEQ ID NO: 355 - DNA, 234 bp, synthetic construct
  source 1..234: mol_type = other DNA
atggatagcaccaatgtgcgttccggaatgaagagccgcaaaaagaagcccaagactacagttatcgatgacgatgatgattgcatgacgtgttctgcctgtcagtctaaattggttaagatttccgacatcacaaaagtatcattggattatattaatactatgaggggtaatacactggcctgcgcagcatgcggatcgtcgcttaaacttcttaacgattttgcgagttaa

SEQ ID NO: 356 - DNA, 354 bp, synthetic construct
  source 1..354: mol_type = other DNA
atgataactttatttttaatcctatgttatttcattcttatttttaatattatagtacctgcaatatctgaaaaaatgagacgcgaacgagccgcatacgtaaactacaaacgtctaaacaagaatttcatttgtgtcgatgatagactgtttagttataattttacaacatctggaattaaggcaaagatggccgttgataacaaaaatgttcccattccatgttccaagataaacgaggtcaataataataaagatgtcgatacactatattgtgataaagatagagacgatataccaggttttgcacgatcgtgctatagggcatattctgacttattttttactacctaa

SEQ ID NO: 357 - DNA, 1281 bp, synthetic construct
  source 1..1281: mol_type = other DNA
atgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtga

SEQ ID NO: 358 - DNA, 387 bp, synthetic construct
  source 1..387: mol_type = other DNA
atggaaaatgtgtttttcttttttacttttacaaatgtatgttctctaaccttggatcgtattaaatggtctacatcttttactaatatcttttttcctgattttgttataacgctaggaataaaaatattatctcctatacgatctaccttgatggactcaatatacatgaacgagaatttgaaaaagtctacaacttgccgcctaagttctcccaacttaatatacgatatggatatttttggaaatttatcatcgaaagagcgttctataatagagtataactcgtcgtcaaataatgtgtcttcctctatttcaatttctaaatatttgggtatgtttaatccgtactcactagctagtttaaatatattaactggagactga

SEQ ID NO: 359 - DNA, 222 bp, synthetic construct
  source 1..222: mol_type = other DNA
atgttattaactaacgttataaaatccgcttctggatatcccaaacattctctgcttaaatcaaatgctgattggttttttatttttcgttttacagttccggatttattaatctcatcaactaactcatcgacagttgcgcactcattaatatctaatttattagtcaattgctttaagcctgcactaccaaccttagagaaatactttccgttaacataa

SEQ ID NO: 360 - DNA, 564 bp, synthetic construct
  source 1..564: mol_type = other DNA
atggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaa

SEQ ID NO: 361 - DNA, 186 bp, synthetic construct
  source 1..186: mol_type = other DNA
atgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattag

SEQ ID NO: 362 - DNA, 1149 bp, synthetic construct
  source 1..1149: mol_type = other DNA
atggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatga

SEQ ID NO: 363 - DNA, 3495 bp, synthetic construct
  source 1..3495: mol_type = other DNA
atgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacgccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaa

SEQ ID NO: 364 - DNA, 222 bp, synthetic construct
  source 1..222: mol_type = other DNA
atggatgtttcgttactactaggaaaacagacaggtcggttttctcccttattgttgtacggcttagcagaatatgcggctgttaaaataacttctatcaacatagatatagtttttctagagaagatggatgtagaattaataatgacatctggcgtgataccattttcgtcgtatggaagttccgtttcatccgcgacatacgcgactgttcccttttga

SEQ ID NO: 365 - DNA, 630 bp, synthetic construct
  source 1..630: mol_type = other DNA
atggaaacaatcaaagcgttggagaaatttatggagttcgatcgccttcagaaagactgctctgataaactcgatagagagagggagagacgcatgaaggctgaacgtgaaatcgctcgtaaaaactgcggaggtaacccatgcgaacgtgaattggaatctgaacgtagtaacgtgaagaggttggaatatcaactagatgcggagaaagaaaaagttaagttctacaaaagagaactagaacgtgatcggtatctttctagtagatatcttacctcttcttcagatccacatgagaaaccattaccaaattatacattttctcgcattaaaaatgtatctccgttgacaactgaggctacaggttctgtagaagtagcacctccatccacagacgttaccgaaccgattagtgatgtgacaccatcggtggatgccgaaccagaacatccacagctttctgaatatcagacttcagtatcccaagtagcagttacacctccaccaaaacctgaaactccacagattttcgaatatcagacgtccgattctatagttaacaatccacgcccattttataattcggatctcgaatttgatgatattgatatgtatctactaccaaactag

SEQ ID NO: 366 - DNA, 162 bp, synthetic construct
  source 1..162: mol_type = other DNA
atggtggtagcaatggaaacatggaccaatacaaacgggaaattgaatctcttaaacgcgagctcgccgagtgtagacgtggtaacaatggatctcacagtgattgcgcgtactatgacgaagaagcaagagaggaagttaagagctgactcaattgcatga

SEQ ID NO: 367 - DNA, 684 bp, synthetic construct
  source 1..684: mol_type = other DNA
atgaaaccaatgctgaaacagagagagatgcgacgtcttagagatagaatctcagatattgaaagacagttgagtgactgcagacgtaataatgaaagcaatgctgatatggaaagagagatgcaacgtcttagagatagaatcatggatcttgatagacagcttaacgagtgtaaacgcaacggtaacggaacatcttctgaggaggtaaataggctaaagactagaatcaggaatcttaaacgatcgctagagatctgctcaaaggatgaatcagaactctattcagcatataaaactaaactcggacgtgctagggaacaaattagtaacttgcaagaaagtctacgtagagagcgtgaatctgacaaaacagatagttactacaggagggaattgactcgcgaaagaaataaaatcgtagaattggaaaaagaacttaataagtgtttcgatgccaagtacatcgacgaaatcaattccaagaaaacccgtatttctgatctcgaacgacaactagcagcctgtaaatctaatggtggtagcaatggaaacatggaccaatacaaacgggaaattgaatctcttaaacgcgagctcgccgagtgtagacgtggtaacaatggatctcacagtgattgcgcgtactatgacgaagaagcaagagaggaagttaagagctga

SEQ ID NO: 368 - DNA, 174 bp, synthetic construct
  source 1..174: mol_type = other DNA
atgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtag

SEQ ID NO: 369 - DNA, 2178 bp, synthetic construct
  source 1..2178: mol_type = other DNA
atggaggtcacgaaccttattgaaaaatgtaccaagcactccaaagatttcgccactgaggtagaaaaactatggaacgatgagttgagttctgaatcaggtctctcaagaaaaacaagaaatgtaattcgtaatattcttcgtgatatcactaagtcattaactacagataagaaatcaaagtgtttccgtatactagaacgttcgacgattaacggagagcagattaaagatgtatataaaactatttttaataatggtgttgatgtggagtctagaatcaacactacaggaaagtatgttctatttacagttatgacttatgttgctgctgaactacgtctcattaagtcagacgagatattcgctcttctattaagattttttaacatgatatgtgatattcatagaaaatacggatgtggtaatatgtttgttggtattcccgctgctctaattaatctattggaaattgatcacattaacaaactgtttagcgtgtttagtacaagatatgacgccaagacatacctatacactgaatattttcttttccttaacattaatcattatctacttagtggttcagatttatttatcaacgtagcatatggtgctgtatctttttcgtcacccattagtgttccagattatatcatggaagcactgacatttaaggcatgtgatcatattatgaaatctggagatctaaaatatacatatgcgtttactaaaaaggttaaggatctgtttaatactaaatctgattctatttatcaatacgttagacttcatgaaatgtcatatgatggtgtttcagaagatacggatgatgacgatgaggtattcgctatccttaacttgagtattgattccagcgttgatagatacagaaacagagttcttctactaactcccgaagtcgcgtctcttagaaaagaatattctgaagtagaacccgattataaatacttgatggatgaggaagtgcccgcgtacgacaagcatttgcctaagcctattactaacactggtattgaagaaccacacgctactggaggagatgaggaccaaccaattaaggttgtccatccccctaataatgataaagatgatgctatcaagccatacaatccattagaagatcctaattatgttcccacaattacaagaacggctataggaatcgctgattaccaactagttattaataaactaattgaatggttagataaatgcgaggaagaatgcggaaatagtggagagtttaaaacagagttggaagaagccaagagaaaactcaccgaattgaatgcagaacttagtgataaactcagtaagattaggactttggaaagggattctgtttataaaaccgaaagaatcgaccgacttacaaaagagatcaaagaacacagggatattcaaaatgggacagatgatggttcagatttattagaaattgataagaagactatccgagaattgagagaatcgcttgatagggaacgagaaatgcgttcagaactagaaaaggaactggatactattaggaatggaaaagtagatggatcttgtcaacgagaacttgaactcagtcgtatgtggctaaaacaacgcgatgacgatctccgagctgaaatcgataaacgtcgtaatgtcgaatgggaactgtccagacttcgtagggatatcaaggaatgcgacaaatacaaggaggatcttgataaggccaagacaactattagtaactacgtaagcaaaatcagtactctagaatcagaaattgctaaatatcaacaagatagggacacgctttctgtagtacgcagagaacttgaggaagaacgacgacgcgttagagatctcgaatctagactcgatgaatgtacacgcaaccaggaagacacgcaagaagttgatgcactgcgttcgcgtattagagaactagagaataagttgaccaactgcatcgagagcggaggaggaaatcttacagagattagcagactccaatctaaaatttcagatcttgaaagacaactgagtgaatgccgtgaaaatgctacagagattagcagactccaatctagaatatcagatcttgaaagacagttgaacgactgtagacgtaataatgaaaccaatgctgaaacagagagagatgcgacgtcttag

SEQ ID NO: 370 - DNA, 1509 bp, synthetic construct
  source 1..1509: mol_type = other DNA
atggcgaacattataaatttatggaacggaattgtaccaacggttcaagatgttaatgttgcgagcattactgcgtttaaatctatgatagatgaaacatgggataaaaaaatcgaagcaaatacatgcatcagtagaaaacatagaaacattattcacgaagttattagggactttatgaaagcctatcctaaaatggatgagaataaaaaatctccattaggagccccaatgcaatggctaacacaatattatattttaaagaatgaatatcataagaccatgctagcgtatgataatggatcattgaatacaaaatttaaaacgttaaacatttatatgattactaacgttggtcaatatattttatatatagtattttgtataatatctggtaagaatcacgatggtactccttatatatacgattctgagataacgagcaatgataaaaattttattaatgagcgtatcaagtatgcatgtaagcaaatattacacggtcaattaactatagctctgagaattagaaataaattcatgtttataggatcacccatgtatttatggtttaacgtaaacggatcacaggtatatcacgacatatatgatcgtaatgccggttttcataataaagagataggtagactactatacgcatttatgtactatctatctataagtggtagatttttgaatgatttcgcactattaaagtttacgtatttaggagaatcctggacatttagtttgagtgtccctgaatatatattatatggtttaggatattctgttttcgatactattgaaaaatttagcaatgatgctatactcgtttatattagaacaaacaatagaaatggatatgattatgtagagtttaataaaaaaggaattgctaaggtgacagaagataaacccgataacgataagcgaattcatgctataagactcatcaacgatagtactgatgttcaacacatacattttgggtttagaaatatggtaataatagacaatgaatgcgctaatattcagtcgagtgctgaaaatgcaactgatacaggacatcatcaagatagcaaaataaatatcgaagtcgaagatgatgatgatgtcatagacgatgatgattataatccaaaacccactccgataccggagcctcaccctagaccaccgtttcccagacatgaatatcataagaggccgaaacttcttcctgtagaagaacctgatcctgtcaaaaaagacgcggatcgtataagacttgataatcatatattaaacacattggatcataatcttaatttcatcggacactattgttgtgatacagcggcagttgataggttagaacatcacatcgaaacattgggacaatatgcagtaatactagcaagaaagataaatatgcaatcattactgttcccatggccattacctactgtccatccacatgcgatagatggtagtattccgccacatgggagatttacgatcttataa

SEQ ID NO: 371 - DNA, 501 bp, synthetic construct
  source 1..501: mol_type = other DNA
atgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaa

SEQ ID NO: 372 - DNA, 333 bp, synthetic construct
  source 1..333: mol_type = other DNA
atggacggaactcttttccccggagatgacgatcttgcaattccagcaactgaatttttttctacaaaggctgctaaaaagccagaggctaaacgcgaagcaattgttaaagccgatgaagacgacaatgaggaaactctcaaacaacggctaactaatttggaaaaaaagattactaatgtaacaacaaagtttgaacaaatagaaaagtgttgtaaacgcaacgatgaagttctatttaggttggaaaatcacgctgaaactctaagagcggctatgatatctctggctaaaaagattgatgttcagactggacggcgcccatatgagtaa

SEQ ID NO: 373 - DNA, 441 bp, synthetic construct
  source 1..441: mol_type = other DNA
atgaactctctatcaattttttttattgtggtagcgacggctgcggtgtgtttactttttatccagggttactcaatatatgaaaattatggcaatattaaggaatttaatgctactcatgcagcattcgaatattcaaaatctataggtggaacaccggcattagataggagagttcaagatgtcaacgacacaatttctgatgtaaagcaaaagtggagatgtgtggtttatccaggaaacggttttgtatccgcttccatatttggatttcaggcagaagttggacccaataatactagatccattagaaaatttaacacgatgcaacaatgtatagactttacattttctgatgttattaacatcgatatttataatccatgtgttgtaccaaatataaataacgcagagtgtcagtttctaaaatctgtactttaa

SEQ ID NO: 374 - DNA, 918 bp, synthetic construct
  source 1..918: mol_type = other DNA
atgcagcatccgcgggaagagaattcaatcgtcgttgaactcgaaccctcattggctacatttatcaaacaaggatttaataatctcgtaaaatggcccttgttaaacattggaatagttttgtctaatacatctaccgctgtcaatgaggaatggctaactgcggtagagcatattcccaccatgaagatattttacaaacatatacataagatacttactagagaaatggggtttttagtctatttgaaaagatcccaatctgaacgcgataattatataactttatacgattttgattattatattatagataaggatacaaattctgtaactatggtagataaaccgaccgagttaaaggaaactttgttacatgtatttcaagaatatcgtttaaagagttctcaaacaatagagcttatagcgtttagttcaggtacggtaataaacgaagacatagtttcaaaattaacatttttagatgtggaggtatttaatagagaatataataatgttaaaactatcatagatccggattttgtatttagatctccatttatagttatttctcctatgggtaaactaactttcttcgtagaagtatattcgtggtttgattttaaatcgtgtttcaaagatattatagatttcttagaaggtgctctaatagccaatattcataatcacatgattaaggtaggtaattgtgacgaaacagtatcgtcttataatccagagtctggaatgttgtttgttaatgacttaatgactatgaacatagtcaactttttcggatgtaattctaggttagaatcataccatcggttcgatatgacaaaagtagatgttgaactatttattaaagcattgtctgatgcgtgtaaaaaaattttgtcagcttctaatagattataa

SEQ ID NO: 375 - DNA, 213 bp, synthetic construct
  source 1..213: mol_type = other DNA
atggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattga

SEQ ID NO: 376 - DNA, 234 bp, synthetic construct
  source 1..234: mol_type = other DNA
atggaagaccttaacgaggcaaacttctcacatttattgataaatttatctaataataaagatatcgatgcgcaatacgcgtctacattatccgtggtacatgaattgctatccgctataaattttaaaatatttaatataaacaaaaagtcgaaaaagaattccaaatcaatcgaacaacatcccgtcgttcatcatgcagcatccgcgggaagagaattcaatcgtcgttga

SEQ ID NO: 377 - DNA, 375 bp, synthetic construct
  source 1..375: mol_type = other DNA
atggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattga

SEQ ID NO: 378 - DNA, 813 bp, synthetic construct
  source 1..813: mol_type = other DNA
atgaattgtttccaagaaaaacaattttcaagagaaaatttattaaaaatgccgtttagaatggttttaacgggaggatctggatctggaaaaactatctatttactatctctgttttctacactagttaaaaaatataaacatatattcttgtttacacccgtttataatccagattatgatggatacatttggccaaatcatattaatttcgttagtagtcaggaatctctagaatataatctgatacgaactaaaagtaacatagaaaaatgtattgctgtcgcacaaaatcataaaaaatcagcacactttttacttatttttgatgatgtaggcgataaactatcaaaatgcaatactctaatagaattcttaaactttggaaggcatttaaacacgtctattattctactatgccaaacttatagacacgtaccaatattaggacgggctaacattacgcatttttgtagttttaacatttccatctcagacgcggaaaatatgctacgatcgatgcctgtaaaggggaaacgaaaggatatattaaacatgttgaatatgatacagaccgctagatccaataatcgattggctattattatcgaagactccgtattttgtgaaggtgaattacgtatatgtaccgataccgctgataaggacgtcatagaacaaaagttaaacatcgatattttagtaaatcaatattcgcacatgaaaaagaatctaaacgctatattagaaagtaaaaaaacaaaattgtgcaatagcgatcaatcatcgtcgtcaaaaaatgtatcatcataa

SEQ ID NO: 379 - DNA, 267 bp, synthetic construct
  source 1..267: mol_type = other DNA
atgtttaacttttgttctatgacgtccttatcagcggtatcggtacatatacgtaattcaccttcacaaaatacggagtcttcgataataatagccaatcgattattggatctagcggtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataa

SEQ ID NO: 380 - DNA, 558 bp, synthetic construct
  source 1..558: mol_type = other DNA
atgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaa

SEQ ID NO: 381 - DNA, 507 bp, synthetic construct
  source 1..507: mol_type = other DNA
atgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtga

SEQ ID NO: 382 - DNA, 231 bp, synthetic construct
  source 1..231: mol_type = other DNA
atgtcggaatattttatatcccgtacatctatttggacagtttttatgttacctataatgtatggtcctataaagtccatgattgagatatcgagatcatcatacaatgtatctgttatagtcaacacacccattggagtaataacaaacgcggcgtccatggcggcgtacgttaacgacttattattaattcattttttgttgtcacttgtagaattttttaacacatag

SEQ ID NO: 383 - DNA, 531 bp, synthetic construct
  source 1..531: mol_type = other DNA
atggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataa

SEQ ID NO: 384 - DNA, 627 bp, synthetic construct
  source 1..627: mol_type = other DNA
atgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtga

SEQ ID NO: 385 - DNA, 138 bp, synthetic construct
  source 1..138: mol_type = other DNA
atgttctgtatctatataatatctacagtcattattagcaataaaattgctaattttagaaatgccgaatacagggaatatctccatttgtacaacgtgacggcagcaataatactaaatattacttcaattttataa

SEQ ID NO: 386 - DNA, 792 bp, synthetic construct
  source 1..792: mol_type = other DNA
atggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaa

SEQ ID NO: 387 - DNA, 252 bp, synthetic construct
  source 1..252: mol_type = other DNA
atgctcatatttatattatcaattctaccgtacaatatttgttccttgataggtacagaattgtacgactgcatttttttgtatactaagtcgaatggatgctcgaggttacaaacatgtattaaagtatcttgctcgatgctagaatttatgtacttggcagaggacatacctatacagtttgatggaataggaaactgcttattgtcgatggttataatggaataccacttattattcgcaaatatctga

SEQ ID NO: 388 - DNA, 174 bp, synthetic construct
  source 1..174: mol_type = other DNA
atggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctag

SEQ ID NO: 389 - DNA, 834 bp, synthetic construct
  source 1..834: mol_type = other DNA
atgtcaagagttagaatatcgttgatatacctctatacgttggttgttataacaactacaaagaccatagagtatacagcatgtaatgataccatcattattccgtgtactatagataatccgacaaagtatattagatggaaattggataaccatgatattttaacttataataaaacttccaagacgacaatattaagtaaatggcatactagtgctagacttcattcgttatcagatagtgatgtctcattgattatggaatataaagatatcttaccaggtacttatacatgcggggataatactggaataaaatctactgtgaaattagttcaacttcatactaattggtttaatgattaccaaacaatgttgatgtttatctttacgggcattactttattcttattatttctcgagatcacttatacatcgatatccgttgtattttctactaatttaggaatcttacaagtatttggttgtgttattgccatgatagagttatgcggagcatttttgttttatccgtcaatgtttactctccggcatattattggattgttgatgatgacgttaccatctatatttcttataattactaaagtattttcattttggttactgtgtaaattatcatgcgctgtacacctcattatctactatcaattggccggatacattttaacggttttgggtttgggattgagtttaaaggaatgtgttgatggtactctgttattatctgggttgggaactattatggtgtctgaacattttagcctgttatttctagtctgctttccgtcaacgcaaagagactattactag

SEQ ID NO: 390 - DNA, 252 bp, synthetic construct
  source 1..252: mol_type = other DNA
atgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatag

SEQ ID NO: 391 - DNA, 633 bp, synthetic construct
  source 1..633: mol_type = other DNA
atgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaa

SEQ ID NO: 392 - DNA, 270 bp, synthetic construct
  source 1..270: mol_type = other DNA
atgaagtatattctatattcccgatgttcattttccttctcctttatatcgaaccatttaacaccagacggtccttcgaagataggttggttagataaaggctttataatatcatctagtacattatatttttctatgacttcaaacgtggtatgtggaacaacttttccagctggtaaacatataccaggagctggagacggcaattgctttgtatatccttccaattttgacgtagaaaaagattgtttaatggtattcatagaatag

SEQ ID NO: 393 - DNA, 246 bp, synthetic construct
  source 1..246: mol_type = other DNA
atgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaaacctgggaggaaggacgtaa

SEQ ID NO: 394 - DNA, 660 bp, synthetic construct
  source 1..660: mol_type = other DNA
atgtactcgttattatttattattttgatgtgtataccatttagttttcaaacagtgtatgatgataaatcggtatgcgattctgacaataaagaatatatgggaatcgaagtttacgtagaagcaacactagacgaacacctcagacaaacaacgtgtgaatccgaaatccataaatatggcgcatctgtatcaaacggaggattaaatatttctgttgatttattaaactgttttcttaattttcatacagttggtgtatacactaatcgcgataccgtatacgcgaagtttgctagtttggatccatggactacggaacctataaattctatgacccatgacgatctagtaaaattaacagaagaatgtatagtggacatttatttaaaatgtgaagtggataaaacaaaggatttcatgaaaactaatggcaatagattaaaaccaagagactttaaaactgttcctccttctgatgtaggaagcatgatagaactacagtctgactattgcgtaaacgatgtgactgcatacgtcaaaatatacgatgagtgcggaaacattaaacagcattccattccaacactaagagattattttaccaccaagaatggtcaaccacgtaaaatattaaagaaaaaatttgataattgttaa

SEQ ID NO: 395 - DNA, 402 bp, synthetic construct
  source 1..402: mol_type = other DNA
atggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaa

SEQ ID NO: 396 - DNA, 585 bp, synthetic construct
  source 1..585: mol_type = other DNA
atgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaa

SEQ ID NO: 397 - DNA, 237 bp, synthetic construct
  source 1..237: mol_type = other DNA
atgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataa

SEQ ID NO: 398 - DNA, 1041 bp, synthetic construct
  source 1..1041: mol_type = other DNA
atggccgtgtacgcggttactggtggtgccggatttctaggcaggtatatagtaaaactgttaattagtgcagatgatgttcaagaaatcagagtcatagatattgtagaagatccacaaccaataacctcgaaagttaaggttataaactatatacaatgtgatataaacgactttgataaggtgagagaagcgctagatggggtaaatctgattattcatacggctgctctagtggatgtatttggaaaatacaccgataatgaaatcatgaaagtaaactattatggaacacagactatattggcagcttgtgtggacctaggaatcaagtatttgatctatactagtagcatggaagcaataggacccaataaacacggtgatccattcatcggccatgagcataccctttatgatatatcaccaggacatgtatacgcaaaaagtaaacgtatggccgagcaactggttatgaaagccaataattccgtaatcatgaatggagcaaaattgtatacttgttgcctaagacccactggaatttacggagaaggagacaaattgacgaaagtcttttacgagcaatgtaagcaacacggtaacattatgtatcgtacagtcgatgatgacgcggtgcatagccgggtatatgtaggaaatgctgcatggatgcacgtgttggctgcaaaatatatccagtatccgggatctaagattaaaggaaatgcttacttttgctacgattactctccatcgtgttcgtacgatatgtttaatcttctattgatgaaaccattgggaatagaacaaggatctagaattccaagatggatgctaaaaatgtacgcgtgcaagaatgatatgaagagaattctatttagaaaaccatcactactcaacaactatacgttgaagatatccaacactacatttgaggtgcgtaccaacaatgcagaactagatttcaactactcccctatctttaacgtcgatgtggcattcgaacgaacacggaaatggctagaagaatcagaataa

SEQ ID NO: 399 - DNA, 378 bp, synthetic construct
  source 1..378: mol_type = other DNA
atggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttga

SEQ ID NO: 400 - DNA, 723 bp, synthetic construct
  source 1..723: mol_type = other DNA
atggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataa

SEQ ID NO: 401 - DNA, 318 bp, synthetic construct
  source 1..318: mol_type = other DNA
atgctctcagtgtgtccgcgtagatacttacatagattgtatcgtagtctagatagctcagatattggaatactatcagatatatgttcggctaatgccatacacctatactttttatttgtcaattcccaatgtttagatactagactagatagagctactactattctagaatcacaacatatcatatcctttacaaagttgacaaagtcaaatagtcccgaatcggagtctactttaagtttctcattaaataatagatcaatgtctccatactgtttaatagccaaatcatctagtgtcatcaatgccgaataa

SEQ ID NO: 402 - DNA, 735 bp, synthetic construct
  source 1..735: mol_type = other DNA
atgggtaacaaaaatattaaaccatctaaggaaaatagactgtccatcttgtccaaggataagatggattcatttaagagaggatcttgggcaacgtcatcctttaaagaaaagtcgcgtgcaaccatccaaagattttcatctcttagacgagaacatattaaagtagaccatcctgacaagttcctggagttaaagagagggatatatgaaataattcagaaatcgtcgtctatagatgtggacaaacggactaagctcatgtccaacataaaaacgatgatgataaatccattcatgatcgagggtttaatgacatctttagaaaacttggatcccgataacaagatgagctactcatcagtgatgatattgggagaattcgacatcatcaatataagcgacaatgaggcggcgttcgagttcataaacagtctgttgaaatctcttctcttgttaaatactagacaactaaaactcttggaatactccattagtaatgacttgttgtatgcccacataaatgcgttggagtatatcataaaaaatacatttaatgttccagaacggcaactgattctgagaggtcaatacctaactccaattttcagtgatttgttaaagtatgcgggtctaaccataaagtcaaacatacttatgtggaataaacagtttatcaaaccagtatctgacctctatacatctataagactcctttattgtgttacagtataa

SEQ ID NO: 403 - DNA, 189 bp, synthetic construct
  source 1..189: mol_type = other DNA
atgatatactccaacgcatttatgtgggcatacaacaagtcattactaatggagtattccaagagttttagttgtctagtatttaacaagagaagagatttcaacagactgtttatgaactcgaacgccgcctcattgtcgcttatattgatgatgtcgaattctcccaatatcatcactgatgagtag

SEQ ID NO: 404 - DNA, 162 bp, synthetic construct
  source 1..162: mol_type = other DNA
atggttgcacgcgacttttctttaaaggatgacgttgcccaagatcctctcttaaatgaatccatcttatccttggacaagatggacagtctattttccttagatggtttaatatttttgttacccatgatctataaaggtagacctaatcgtctcggatga

SEQ ID NO: 405 - DNA, 180 bp, synthetic construct
  source 1..180: mol_type = other DNA
atgatgttcatacattgtgttgtttttccagatttgtccaatccttcaaaaacgattaatgccccacgagacatttttgtaaacctaacatattttttacaatttatgcgtataataaaactgaaaataaatatatggtcatccgagacgattaggtctacctttatagatcatgggtaa

SEQ ID NO: 406 - DNA, 615 bp, synthetic construct
  source 1..615: mol_type = other DNA
atgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaa

SEQ ID NO: 407 - DNA, 489 bp, synthetic construct
  source 1..489: mol_type = other DNA
atggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtga

SEQ ID NO: 408 - DNA, 1659 bp, synthetic construct
  source 1..1659: mol_type = other DNA
atgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaa

SEQ ID NO: 409 - DNA, 201 bp, synthetic construct
  source 1..201: mol_type = other DNA
atgttcgtctacaagaacaatttcagaatccaatacgatagacgtagcttttttaaatgctttcggtatgtattctttgagataatccactttatgagagagtactggtttcatgtttctactaaagaaggcaaactcgttattatttttatgaacttgtactctttcaccatcgtatttgacttccgcaaacattcctga

SEQ ID NO: 410 - DNA, 204 bp, synthetic construct
  source 1..204: mol_type = other DNA
atgtccgtcatatcgaatccatcaaagtacaaacagtcaaacacgaacaaacacatgttagagtttttatattctttctttttgtgtattcctaaacttccaaacggtagcggtacattatgttcgtctacaagaacaatttcagaatccaatacgatagacgtagcttttttaaatgctttcggtatgtattctttgagataa

SEQ ID NO: 411 - DNA, 1005 bp, synthetic construct
  source 1..1005: mol_type = other DNA
atggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatgaatgtttccttttttaccaaaggaaatgcctcgttgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataa

SEQ ID NO: 412 - DNA, 573 bp, synthetic construct
  source 1..573: mol_type = other DNA
atggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatag

SEQ ID NO: 413 - DNA, 324 bp, synthetic construct
  source 1..324: mol_type = other DNA
atgacccgttggtggcggagtaggtatatctgccgtagccaatgtagtaatgtaaaaaatagtacatgcagtcagcaaattctttatatccatcttttaatattatcatatactacaataacaaaatctttttttaaaacgttaaaccaccatcaaaaatccatgtttaaagttatcagattaaaatatattttcgaaattaatagctgtatatcttatccatcaattttagatttatatattttcgaaattaatagctgtatatctcatccatcaattttagatttatatgttttgaaaaacactatcttactcatactctag

SEQ ID NO: 414 - DNA, 399 bp, synthetic construct
  source 1..399: mol_type = other DNA
atgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttga

SEQ ID NO: 415 - DNA, 297 bp, synthetic construct
  source 1..297: mol_type = other DNA
atggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaa

SEQ ID NO: 416 - DNA, 180 bp, synthetic construct
  source 1..180: mol_type = other DNA
atgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatga

SEQ ID NO: 417 - DNA, 1695 bp, synthetic construct
  source 1..1695: mol_type = other DNA
atgaatagcagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacgaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttga

SEQ ID NO: 418 - DNA, 948 bp, synthetic construct
  source 1..948: mol_type = other DNA
atgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctag

SEQ ID NO: 419 - DNA, 138 bp, synthetic construct
  source 1..138: mol_type = other DNA
atggctgtctttcctgaaccagatggtccgctcaatatgatagattttactatcccagacatttatgtaagtcaaaaatctagactttgttctctgttttgtatttacgtgaacgtttattatatatataatatgtaa

SEQ ID NO: 420 - DNA, 456 bp, synthetic construct
  source 1..456: mol_type = other DNA
atggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattag

SEQ ID NO: 421 - DNA, 903 bp, synthetic construct
  source 1..903: mol_type = other DNA
atgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaa

SEQ ID NO: 422 - DNA, 189 bp, synthetic construct
  source 1..189: mol_type = other DNA
atggtatttaagatttcgattccgatcaacatcaccgacctttttggtaatctattattattggctctgatcaccgcatctagatctgcacctaatctattaattaccaagaatcgatattccacattaatggatttgtatagaccaaatgccttgcacgtgataagacctacgtgctttatattgtga

SEQ ID NO: 423 - DNA, 324 bp, synthetic construct
  source 1..324: mol_type = other DNA
atggtaatatattgcagcaattctctaggtgcatattgcaaactggtcattaacaaagtcgcagtattgttaacatatttctgttttgtggcacttactaatgcacaattctttgtttcagatatcttagtccatggcaagatacctcccaaccatctaatcatacaatatccaagtgtttctagatctccacgtctagatacaacgtatcctttatgcgaatctataggtgtaaattctagagtaccgttatccattttatttggatttcttataaatggaacatgttcgccattagacatgaatttagaaaccaatccgtaa

SEQ ID NO: 424 - DNA, 660 bp, synthetic construct
  source 1..660: mol_type = other DNA
atggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgctacagatcccaaatctggtaaaagttaaacttggggagaatgatacagaaaatctttcttctactatatcggcggcaccatcgaggtaa

SEQ ID NO: 425 - DNA, 288 bp, synthetic construct
  source 1..288: mol_type = other DNA
atgcgtatgcacataacagcattctttaccattcacaatatcaaaatgatcatatacaacagaccacatatggcgtatagtttccaaacgtttcatgagtacattattcacgcggtcttcttgagaggtggttacctcgatggtgccgccgatatagtagaagaaagattttctgtatcattctccccaagtttaacttttaccagatttgggatctgtagcaccgcaccctttttgaatctcattctcataatttcctttccatgtacgtccacagcagtaacttga

SEQ ID NO: 426 - DNA, 375 bp, synthetic construct
  source 1..375: mol_type = other DNA
atgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaa

SEQ ID NO: 427 - DNA, 1677 bp, synthetic construct
  source 1..1677: mol_type = other DNA
atggatttttttaaaaaggaaatacttgactggagtgtatatttatctcttcattatatagcacgcgtgtgttccaattcttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgcagaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactatccacatatctaaaaatcttataa

SEQ ID NO: 428 - DNA, 114 bp, synthetic construct
  source 1..114: mol_type = other DNA
atgttcgaacgagattataatcctgtattatatgggatgtggaagaattggaacacacgcgtgctatataatgaagagataaatatacactccagtcaagtatttcctttttaa

SEQ ID NO: 429 - DNA, 954 bp, synthetic construct
  source 1..954: mol_type = other DNA
atgaaaacgatttccgttgttacgttgttatgcgtactacctgctgttgtttattcaacatgtactgtacccactatgaataacgctaaattaacgtctaccgaaacatcgtttaatgataaacagaaagttacatttacatgtgatcagggatatcattctttggatccaaatgctgtctgcgaaacagataaatggaaatacgaaaatccatgcaagaaaatgtgcacagtttctgattatgtctctgaattatatgataagccattatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaa

SEQ ID NO: 430 - DNA, 522 bp, synthetic construct
  source 1..522: mol_type = other DNA
atgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataa

SEQ ID NO: 431 - DNA, 216 bp, synthetic construct
  source 1..216: mol_type = other DNA
atgaatagtattccggtgccaacgcttacagaaacatcgcgttcattcatcattataccattaagtgtatccatcacccattgtttaacacgtgattcatttggcatagtacgtactatatcatcgaacggtataacggcgcatcttgtaaatagcctgtatatattatgtaatatggcgttacttcttccatacacaataaatctcttgttataa

SEQ ID NO: 432 - DNA, 549 bp, synthetic construct
  source 1..549: mol_type = other DNA
atgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcaacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaa

SEQ ID NO: 433 - DNA, 819 bp, synthetic construct
  source 1..819: mol_type = other DNA
atgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataa

SEQ ID NO: 434 - DNA, 189 bp, synthetic construct
  source 1..189: mol_type = other DNA
atggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaa

SEQ ID NO: 435 - DNA, 174 bp, synthetic construct
  source 1..174: mol_type = other DNA
atgaacactgcaatcagttctttcgggatagaaatctttggcaattatacacaaccctattttcaatccccatgtttcctcttcagtcttctcacatcgtctaatagacatggagtagatgatagaggggaacagaaggactataatcagggacctcatcttgaaaatggttag

SEQ ID NO: 436 - DNA, 234 bp, synthetic construct
  source 1..234: mol_type = other DNA
atgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataa

SEQ ID NO: 437 - DNA, 501 bp, synthetic construct
  source 1..501: mol_type = other DNA
atggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattga

SEQ ID NO: 438 - DNA, 852 bp, synthetic construct
  source 1..852: mol_type = other DNA
atggaatccttcaagtattgttttgataacgatggcaagaaatggattatcggaaatactttatattctggtaattcaatactatataaggtcagaaaaaatttcactagttcgttctacaattacgtaatgaaaatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattga

SEQ ID NO: 439 - DNA, 1038 bp, synthetic construct
  source 1..1038: mol_type = other DNA
atggatatcttcagggaaatcgcatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgatgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggttcgtataatcttgtggatactctagtaaagtcaggactgacagaggtgttcggttcaactggagattatagcaatatgtgtaattcagatgtgagtgtcgacgctatgattcacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaa

SEQ ID NO: 440 - DNA, 450 bp, synthetic construct
  source 1..450: mol_type = other DNA
atgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacagttgtattccacactcctctcttttagagatgatgcggaatcagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattga

SEQ ID NO: 441 - DNA, 276 bp, synthetic construct
  source 1..276: mol_type = other DNA
atgtacaactcatcaattcatacgccggaatatgatgttataatccacgtaattgagcatctcaagcatcacaaacaatgcgttcagactgttactagtgggatggtcttcacctccccagtaagtagcagcatatgcacaaagtccgatgatggccgaaatctctctgatggttttttgctcatccggtatataacaacggatgatttctgtacaatctttgacatcatcccacggcatattttttaccagctcgcgaatgtcgatgaacactga

SEQ ID NO: 442 - DNA, 981 bp, synthetic construct
  source 1..981: mol_type = other DNA
atgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtga

SEQ ID NO: 443 - DNA, 228 bp, synthetic construct
  source 1..228: mol_type = other DNA
atggtaataattccaggtgtccgttgtttaagtctcttatttctaaggcgtcgatgtccgctccatataatatctgcgtttacgttactagcaataaatgcattaatattgggacataccatttcgccagtagatctctcatttactatttgtggatacgagataagatctatatttgattctgagacagacacgattgtcaaatttaacgacatcatgtcacagtag

SEQ ID NO: 444 - DNA, 1023 bp, synthetic construct
  source 1..1023: mol_type = other DNA
atgtctagaaagtttatgcaggtgtatgaatatgacagagagcaatatctcgatgagttcattgaagacagatataacgatagttttatcactagtccagaatactatagtgcggaaaaatacatgtgtagatatactacactaaatcacaattgtataaacgtacgacgatgcgcgttagactccaagttattacatgatatcataaccaattgtaaaatatataacaatatagaattagttagggcgacaaaatttgtttattatctggatctgataaaatgtaattgggtatctaaggtaggtgattcagttctatatcccgttatatttataacacatacaagtactagaaatttagataaagtctctgtaaaaacatacaagggcgttaaagtaaaaaaacttaatagatgcgcggatcatgctattgtaattaatccattcgtcaagtttaaactaacgttgccgaacaaaacaagtcatgcaaaggtattggttacattttgtaagttaagaacggatataacgcagatagaggcaccgctttcgggcaatgttttagtttatacatttcctgacattaataaaagaattcctggatatatacatgtcaacatagaaggatgtatcgatggaatgatttatataaattcttcaaagttcgcgtgtgttttaaaactacatagatcaatgtatcgcattccaccctttcctatagatatctgctcttgttgttcacaatatactaacgatgacatagaaattcccattcatgatttaataaaggatgtggcaatttttaaaaataaggagacggtatattatctaaaattaaataataaaactatagctagatttacgtactttaataatatagataccgcaattacacaagaacatgagtatgtcaaaatagcactaggtatagtctgcaagttaatgattaataatatgcatagtatcgtgggagttaatcatagcaatacgttcgtcaattgtttgttggaagataatgtataa

SEQ ID NO: 445 - DNA, 129 bp, synthetic construct
  source 1..129: mol_type = other DNA
atgggaatttctatgtcatcgttagtatattgtgaacaacaagagcagatatctataggaaagggtggaatgcgatacattgatctatgtagttttaaaacacacgcgaactttgaagaatttatataa

SEQ ID NO: 446 - DNA, 1725 bp, synthetic construct
  source 1..1725: mol_type = other DNA
atgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccgtataccatcgattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatag

SEQ ID NO: 447 - DNA, 1056 bp, synthetic construct
  source 1..1056: mol_type = other DNA
atgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaa

SEQ ID NO: 448 - DNA, 957 bp, synthetic construct
  source 1..957: mol_type = other DNA
atggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaa

SEQ ID NO: 449 - DNA, 405 bp, synthetic construct
  source 1..405: mol_type = other DNA
atggaggaggatacaaatatttcaaataaagttataaggtacaacactgtcaataatatatggaagacattacctaacttctggactggaactataaatccaggcgtggtctcgcataaagatgatatatatgttgtatgcgacatcaaagatgaaaaaaatgttaagacttgtatatttagatataacacgaatacgtataacggatgggaattggttacgacgacagaaagcagattatcagctctgcatactattcttcatgacaataccataatgatgttacattgttatgaatcgtatatgttacaagatacatttaatgtgtacactcgcgaatggaatcatatgtgtcatcaacattcgaatagttatatcatgtacaatatactacccatctactaa

SEQ ID NO: 450 - DNA, 1074 bp, synthetic construct
  source 1..1074: mol_type = other DNA
atggatatctttaaagaactaatcttaaaacaccctgatgaaaatgttttgatttctccagtttctattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacgatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataa

SEQ ID NO: 451 - DNA, 171 bp, synthetic construct
  source 1..171: mol_type = other DNA
atgtacatattgcaagttattctcggtacccaccatcatatcaacactggtaactatattcttagaaatataaaacttgtctgtatatgtaagatgtttagaaaatggatatttccacattgctttaaaatggacggcgctaacaactgtcatacgagtattaatggatag

SEQ ID NO: 452 - DNA, 573 bp, synthetic construct
  source 1..573: mol_type = other DNA
atgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttga

SEQ ID NO: 453 - protein, 91 aa, synthetic construct
MSLESFIITTFNNNSSTNIDNMCHLYVKVCPSSLLFRLFVECCDINKLVEGTTPLHCYLMNEGFESSVLKNLLKEYVMNTFNVHDIHYTNI

SEQ ID NO: 454 - protein, 181 aa, synthetic construct
MISLSFLIHNPLKKWKLKPSISINGYRSTFTMASPCAQFRPCHCHATKDSLNTVADVRHCLTEYILWVSHRWTHRESAGSLYRLLISFRTDATELFGGELKDSLPWDNIDNCVEIIKCFIRNDSMKTAEELRAIIGLCTQSAIVSGRVFNDKYIDILLMLRKILNENDYLTLLDHIRTAKY

SEQ ID NO: 455 - protein, 327 aa, synthetic construct
MIAFIIFREIGIISTRIAMDCTCILCRLLDEDVTYKKIKLEIETCHNLSKHIDRRGNNALHCYVFNKCDTDIKIVRLLLSRGVERLCRNNEGLTPLGAYSKHRYVKSQIVHLLISSYSNSSNELKSNINDFDLYSYMSSDNIDLRLLKYLIVDKRIRPSKNTNYAINGLGLVDIYVTTPNPRPEVLLWLLKSECYSTGYVFRTCMYDSDMCKNSLHYYISSHRESQSLSKDVIKCLINNNVSIHGRDEGGSLPIQYYWSCSTIDIEIVKLLIKDVDTCRVYDVSPILEADYLNKRFRVTPYNVDMEIVNLLIERRHTLVDVMRSITS

SEQ ID NO: 456 - protein, 109 aa, synthetic construct
MLFYLEEPIRGYVIILIVHPSWNDCATGHILIMLLNWHEQKEEGQHLLYLFIKHNQGYTLNILRYLLDRFDIQKDEYYNTAFQNCNNNVASYIGYDINLPTKDGIRLGV

SEQ ID NO: 457 - protein, 251 aa, synthetic construct
MSRINITKKIYCSVFFHIFNYEKVNHYEMDEIVRIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDEKGHIPLHHYLIHSLSIDNKIFDILTDTIDDFSKSSDLLLCYLRYKFNGSLNYYVLYKGSDPNCVDEDGLTSLHYYCKHISTFYKSNYYKLSHTKMRAEKRFIYAIIDYGANINAVTHLPSTVYQT

SEQ ID NO: 458 - protein, 140 aa, synthetic construct
MSMKYLMLLFAAMIIRSFADSGNAIETTSPEITNATTDIPAIRLCGPEGDGYCLHGDCIHARDIDGMYCRCSHGYTGIRCQHVVLVDYQRSENPNTTTSYIPSPGIMLVLVGIIIITCCLLSVYRFTRRTKLPIQDMVVP

SEQ ID NO: 459 - protein, 331 aa, synthetic construct
MDIYDDKGLQTIKLFNNEFDCIRNDIRELFKHVTDSDSIQLPMEDNSDIIENIRKILYRRLKNVECVDIDSTITFMKYDPNDDNKRTCSNWVPLTNNYMEYCLVIYLETPICGGKIKLYHPTGNIKSDKDIMFAKTLDFKSKKVLTGRKTIAVLDISVSYNRSMTTIHYNDDVDIDIHTDKNGKELCYCYITIDDHYLVDVETIGVIVNRSGKCLLVNNHLGIGIVKDKRISDSFGDVCMDTIFDFSEARELFSLTNDDNRNIAWDTDKLDDDTDIWTPVTEDDYKFLSRLVLYAKSQSDTVFDYYVLTGDTEPPTVFIFKVTRFYFNMPK

SEQ ID NO: 460 - protein, 184 aa, synthetic construct
MEFDPAKINTSSIDHVTILQYIDEPNDIRLTVCIIRNINNITYYINITKINTHLANQFRAWKKRIAGRDYMTNLSRDTGIQQSKLTETIRNCQKNRNIYGLYIHYNLVINVVIDWITDVIVQSILRGLVNWYIANNTYTPNTPNNTTTISELDIIKILDKYEDVYRVSKEKECGICYEVVYSKR

SEQ ID NO: 461 - protein, 62 aa, synthetic construct
MKLFTQNDRYFGLLDSCTHIFCITCINIWHKTRRETGASDNCPICRTRFRNITMSKFYKLVN

SEQ ID NO: 462 - protein, 126 aa, synthetic construct
MRILFLIAFMYGCVHPYVNADEIKCPNLNIVTSSGEFRCTGCVKFMPNFSYMYWLAKDMRSDEDAKFIEHLGEGIKEDETVSTIDGRIVTLQKVLHVTDTNKFDNYRFTCVLTTIDGVSKKNIWLK

SEQ ID NO: 463 - protein, 237 aa, synthetic construct
MSYACPILSTINICLPYLKDINMIDKRGETLLHKAVRYNKQSLVSLLLESGSDVNIRSNNGYTCIAIAINESRNIELLKMLLCHKPTLDCVIDSLREISNIVDNYYAIKQCIKYAMIIDDCTSSKIPESISQRYNDYIDLCNQELNEMKKIMVGGNTMFSLIFTDHGAKIIHRYANNPELREYYELKQNKIYVEAYDIISDAIVKHDRIHKTIESVDDNTYISNLPYTIKYKIFEQQ

SEQ ID NO: 464 - protein, 137 aa, synthetic construct
MKGIDNTAYSYIDDLTCCTRVIMADYLNSDYRYNKDVDLDLVKLFLENGKPHGIMCSIVPLWRNDKETIFLILKTMNSDVLQHILIEYMTFGDIPLVEYGTVVNKEAIHEYFRNINIDSYTMKYLLKKEGRCHQLSR

SEQ ID NO: 465 - protein, 52 aa, synthetic construct
MAAVFFMRTSTDTRMMIINYEIAVPYCICISSLICIQSRIREHMCVRKLLNV

SEQ ID NO: 466 - protein, 77 aa, synthetic construct
MLKLKDIAMALLEATGFSNINDFNIFSYMKSKNVDVDLIKVLVEHGFDLSVKCENHRSVIENYVMTMILFLKLLICS

SEQ ID NO: 467 - protein, 71 aa, synthetic construct
MFDYLENEEVALDELKQMLRDRDPNDTRNQFKNNALHAYLFNEHCNNVEVVKLLLDSGTNPLRKNWRQLPH

SEQ ID NO: 468 - protein, 634 aa, synthetic construct
MVNDKILYDSCKTFNIDASSAQSLIESGANPLYEYDGETPLKAYVTKKNNNIKNDVVILLLSSVDYKNINDFDIFEYLCSDNIDIDLLKLLISKGIEINSIKNGINIVEKYATTSNPNVDVFKLLLDKGIPTCSNIQYGYKIKIEQIRRAGEYYNWDDELDDYDYDYTTDYDDRMGKTVLYYYIITRSQDGYATSLDVINYLISHKKEMRYYTYREHTTLYYYLDKCDIKREIFDALFDSNYSGHELMNILSNYLRKQFRKKNHKIDNYIVDQLLFDRDTFYILELCNSLRNNILISTILKRYTDSIQDLLLEYVSYHTVYINVIKCMIDEGATLYRFKHINKYFQKFGNRDPKVVEYILKNGNLVVDNDNDDNLINIMPLFPTFSMRELDVLSILKLCKPYIDDINKIDKHGCSILYHCIKSHSVSLVEWLIDNGADINIITKYGFTCITICVILADKYIPEIAELYIKILEIILSKLPTIECIKKTVDYLDDHRYLFIGGNNKSLLKICIKYFILVDYKYTCSMYPSYIEFITDCEKEIADMRQIKINGTDMLTVMYMLNKPTKKRYVNNPIFTDWANKQYKFYNQIIYNANKLIEQSKKIDDMIEEVSIDDNRLSTLPLEIRHLIFSYAFL

SEQ ID NO: 469 - protein, 177 aa, synthetic construct
MSSIRFIACLYLISIFGNCHEDPYYQPFNKLNITLDIYTYEDLVPYTVDNDTTSFVKIYFKKFWITVMTKWCAPFIDTVSVYTSHDNLNIEFYTRDEYDTQSEDKICTIDVKARCNHLTKPEVTVQKEAYRYSLSSDLSCFDSIDLDIDLIETNSTDTTVLKSYELMLPKRAKSIHN

SEQ ID NO: 470 - protein, 150 aa, synthetic construct
MGIQHEFDIIINGDIALRNLQLHKGDNYGCKLKIISNDYKKLKFRFIIRPDWSEIDEVKGLTVFANNYAVKVNKVDDTFYYVIYEAVIHLYNKKTEILIYSDDENELFKHYYPYISLNMISKKYKVKEENYSSPYIEHPLIPYRDYESMD

SEQ ID NO: 471 - protein, 151 aa, synthetic construct
MNAYNKADSFSLESDSIKDVIHDYICWLSMTDEMRPSIGNVFKAMETFKIDAVRYYDGNIYELAKDINAMSFDGFIRSLQTIASKKDKLTVYGTMGLLSIVVDINKGCDISNIKFAAGIIILMEYIFDDTDMSHLKVALYRRIQRRDDVDR

SEQ ID NO: 472 - protein, 204 aa, synthetic construct
MAYMNRSDLDKLKHENIFSGNIIEDAKEFVFGSRKIYTDSVDDLIELYSLAKYLNNENLKDVVIERMDYVCKYIGKDNWSTIYSFYKENGLRNSFLRQYINNNIEEICNTDQFLKLDVDSVCDILDNDEIVVTREYTILNMVLRWLENKRVNIDDFTKVMFVIRFKFITYSELTNAIKKIAPEYRQCLQDLYHMKITRPRHFDN

SEQ ID NO: 473 - protein, 316 aa, synthetic construct
MDTIKIFNHGEFDTIRNELVNLLKVVKWNTINSNVTVSSTDTIDISDCIREILYKQFKNVRNIEVSSDISFIKYNRFNDTTLTDDNVGYYLVIYLNRTKSVKTLIYPTPETVITSSEDIMFSKSLNFRFENVKRDYKLVMCSISLTYKPSICRIQYDNNKYLDISDSQECNNLCYCVITMDPHHLIDLETICVLVDKSGKCLLVNEFYIRFRKNHIYNSFADLCMDHIFELPNTKELFTLRNDDGRNIAWDNDKLESGNNTWIPKTDDEYKFLSKLMNIAKFNNTKFDYYVLVGDTDPCTVFTFKVTKYYINLNYE

SEQ ID NO: 474 - protein, 261 aa, synthetic construct
MKVESVTFLTLLGIGCVLSYCPIPSRPINIKFKNSVETNANYNIGDTIEYLCLPGYRKQKMGPIYAKCTGTGWTLFNQCIKRRCPSPRDIDNGQLDIGGVDFGSSITYSCNSGYQLIGESKSYCELGSTGSMVWNPEAPICESVKCQSPPSISNGRHNGYEDFYTDGSVVTYSCNSGYSLIGNSGVLCSGGEWSDPPTCQIVKCPHPTISNGYLSSGFKRSYSYNDNVDFKCKYGYKLSGSSSSTCSPGNTWKPELPKCVR

SEQ ID NO: 475 - protein, 506 aa, synthetic construct
MESVIFSINGEIIQVNKEIITASPYNFFKRIQEHHINDEVIILNGINYHAFESLLDYMRWKKINITINNVEMILVAAVIIDVTPVVDLCVKTMIHNINSTNCIRMFNFSKQYGIKKLYNASMLEIINNITAVTSDPEFGKLSKDELTTILSHEDVNVNHEDVTAMILLKWIHKNPNDVDIINILHPKFMTNTMRNAISLLGLTISKSTKPVTRNGIKHNIVVIKNSDYISTITHYSPRTEYWTIVGNTDRQFYNANVLHNCLYIIGGMINNRHVYSVSRVDLKTKKWKTVTNMSSLKSEVSTCVNDGKLYVIGGLEFSISTGVAEYLKHGTSKWIRLPNLITPRYSGASVFVNDDIYVMGGVYTTYEKYVVLNDVECFTKNRWIKKSPMPRHHSIVYAVEYDGDIYAITGITYETRNYLYKYIVKEDKWIELYMYFNHVGKMFVCSCGDYILIIADAKYEYYPKSNTWNLFDMSTRNIEYYDMFTKDETHKSLPSFLSNCEKQFLQ

SEQ ID NO: 476 - protein, 224 aa, synthetic construct
MVKNNKISNSCRMIMSTNPNNILMRHLKNLTDDEFKCIIHRSSDFLYLSDRDYTSITKETLVSEIVEEYPDDCNKILAIIFLVLDKDIDVDIKTKLKPKPAVRFAILDKMTEDIKLTDLVRHYFRYIEQDIPLGPLFKKIDSYRTRAINKYSKELGLATEYFNKYGHLMFYTLPIPYNRFFCRNSIGFLAVLSPTIGHVKAFYKFIEYVSIDDRRKFKKELMSK

SEQ ID NO: 477 - protein, 117 aa, synthetic construct
MRTLLIRYILWRNDNDQTYYNDDFKKLMLLDELVDDGDVCTLIKNMRMTLSDGPLLDRLNQPVNNIEDAKRMIAISAKVARDIGERSEIRWEESFTILFRMIETYFDDLMIDLYGEK

SEQ ID NO: 478 - protein, 175 aa, synthetic construct
MTSSAMDNNEPKVLEMVYDATILPEGSSMDPNIMDCINRHINMCIQRTYSSSIIAILDRFLMMNKDELNNTQCHIIKEFMTYEQMAIDHYGGYVNAILYQIRKRPNQHHTIDLFKRIKRTRYDTFKVDPVEFVKKVIGFVSILNKYKPVYSYVLYENVLYDEFKCFIDYVETKYF

SEQ ID NO: 479 - protein, 472 aa, synthetic construct
MIFVIESKLLQIYRNRNRNINFYTTMDNIMSAEYYLSLYAKYNSKNLDVFRNMLQAIEPSGNNYHILHAYCGIKGLDERFVEELLHRGYSPNETDDDGNYPLHIASKINNNRIVAMLLTHGADPNACDKHNKTPLYYLSGTDDEVIERINLLVQYGAKINNSVDEEGCGPLLACTDPSERVFKKIMSIGFEARIVDKFGKNHIHRHLMSDNPKASTISWMMKLGISPSKPDHDGNTPLHIVCSKTVKNVDIIDLLLPSTDVNKQNKFGDSPLTLLIKTLSPAHLINKLLSTSNVITDQTVNICIFYDRDDVLEIINDKGKQYDFTDFKMAVEVGSIRCVKYLLDNDIICEDAMYYAVLSEYETMVDYLLFNHFSVDSVVNGHTCMSECVRLNNPVILSKLMLHNPTSETMYLTMKAIEKDRLDKSIIIPFIAYFVLMHPDFCKNRRYFTSYKRFVTDYVHEGVSYEVFDDYF

SEQ ID NO: 480 - protein, 220 aa, synthetic construct
MVYKLVLLFCIASLGYSVEYKNTICPPRQDYRYWYFAAELTIGVNYDINSTIIGECHMSESYIDRNANIVLTGYGLEINMTIMDTDQRFVAAAEGVGKDNKLSVLLFTTQRLDKVHHNISVTITCMEMNCGTTKYDSDLPESIHKSSSCDITINGSCVTCVNLETDPTKINPHYLHPKDKYLYHNSEYGMRGSYGVTFIDELNQCLLDIKELSYDICYRE

SEQ ID NO: 481 - protein, 284 aa, synthetic construct
MDLSRINTWKSKQLKSFLSSKDAFKADVHGHSALYYAIADNNVRLVCTLLNAGALKNLLENEFPLHQAATLEDTKIVKILLFSGLDDSQFDDKGNTALYYAVDSGNMQTVKLFVKKNWRLMFYGKTGWKTSFYHAVMLNDVSIVSYFLSEIPSTFDLAILLSCIHTTIKNGHVDMMILLLDYMTSTNTNNSLLFIPDIKLAIDNKDIEMLQALFKYDINIYSANLENVLLDDAEIAKMIIEKHVEYKSDSYTKDLDIVKNNKLDEIISKNKELRLMYVNCVKKN

SEQ ID NO: 482 - protein, 369 aa, synthetic construct
MIALLILSLTCSVSTYRLQGFTNAGIVAYKNIQDDNIVFSPFGYSFSMFMSLLPASGNTRIELLKTMDLRKRDLGPAFTELISGLAKLKTSKYTYTDLTYQSFVDNTVCIKPSYYQQYHRFGLYRLNFRRDAVNKINSIVERRSGMSNVVDSNMLDNNTLWAIINTIYFKGIWQYPFDITKTRNASFTNKYGTKTVPMMNVVTKLQGNTITIDDEEYDMVRLPYKDANISMYLAIGDNMTHFTDSITAAKLDYWSFQLGNKVYNLKLPKFSIENKRDIKSIAEMMAPSMFNPDNALFKHMTRDPLYIYKMFQNAKIDVDEQGTVAEASTIMVATARSSPEKLEFNTPFVFIIRHDITGFILFMGKVESP

SEQ ID NO: 483 - protein, 88 aa, synthetic construct
MLAFCYSLPNAGDVIKGRVYENDYALYIYLFDYPHFEAILAESVKMHMDRYVEYRDKLVGKTVKVKVIRVDYTKGYIDVNYKRMCRHQ

SEQ ID NO: 484 - protein, 424 aa, synthetic construct
MNPDNTIAVITETIPIGMQFDKVYLSTFNMWREILSNTTKTLDISSFYWSLSDEVGTNFGTIILNEIVQLPKRGVRVRVAVNKSNKPLKDVERLQMAGVEVRYIDITNILGGVLHTKFWISDNTHIYLGSANMDWRSLTQVKELGIAIFNNRNLAADLTQIFEVYWYLGVNNLPYNWKNFYPSYYNTDHPLSINVSGVPHSVFIASAPQQLCTMERTNDLTALLSCIRNASKFVYVSVMNFIPIIYSKAGNILFWPYIEDELRRAAIDRQVSVKLLISCWQRSSFIMRNFLRSIAMLKSKNINIEVKLFIVPDADPPIPYSRVNHAKYMVTDKTAYIGTSNWTGNYFTDTCGASINITPDDGLGLRQQLEDIFMRDWNSKYSYELYDTSPTKRCRLLKNMKQCTNDIYCDEIQPEKEIPEYSLE

SEQ ID NO: 485 - protein, 121 aa, synthetic construct
MGATISILASYDNPNLFTAMILMSPLVNADAVSKLNLLAAKLMGTITPNAPVGKLCPESVSRDMDKVYKYQYDPLINHEKIKAGFASQVLKATNKVRKIIPKINTPRLSYSREQTMRLAMF

SEQ ID NO: 486 - protein, 110 aa, synthetic construct
MSANCMFNLDNDYIYWKPITYPKALVFISHGAGKHSGRYDELAENISSLGILVFSHDHIGHGRSNGEKMMIDDFGTYVRDVVQHVVTIKSTYLGVPVFLLGIPWEQQFLY

SEQ ID NO: 487 - protein, 149 aa, synthetic construct
MATKLDYEDAVFYFVDDDKICSRDSIIDLIDEYITWRNHVIVFNKDITSCGRLYKELMKFDDVAIRYYGIDKINEIVEAMSEGDHYINFTKVHDQESLFATIGICAKITEHWGYKKISESRFQSLGNITDLMTDDNINILILFLEKKLN

SEQ ID NO: 488 - protein, 226 aa, synthetic construct
MLSMFMCNNIVDYVDDIDNGIVHDIEDEASNNVDHDYVYPLPENMVYRFDKSTNILDYLSTERDHVMMAVRYYMSKQRLDDLYRQLPTKTRSYIDIINIYCDKVSNDYNRDMNIMYDMASTKSFTVYDINNEVNTILMDNKGLGVRLATISFITKLGRRCMNPVKTIKMFTLLSHTICDDCFVDYITDISPPDNTIPNTSTREYLKLIGITAIMFATYKTLKYMIG

SEQ ID NO: 489 - protein, 147 aa, synthetic construct
MFNMNINSPVRFVKETNRAKSPTRQSPGAAGYDLYSAYDYTIPPGERQLIKTDISMSMPKICYGRIAPRSGLSLKGIDIGGGVIDEDYRGNIGVILINNGKCTFNVNTGDRIAQLIYQRIYYPELEEVQSLDSTNRGDQGFGSTGLR

SEQ ID NO: 490 - protein, 480 aa, synthetic construct
MPIFVNTVYCKNILALSMTKKFKTIIDAIGGNIIVNSTILKKLSPYFRTHLRQKYTKNKDPVTRVCLDLDIHSLTSIVIYSYTGKVYIDSHNVVNLLRASILTSVEFIIYTCINFILRDFRKEYCVECYMMGIEYGLSNLLCHTKNFIAKHFLELEDDIIDNFDYLSMKLILESDELNVPDEDYVVDFVIKWYIKRRNKLGNLLLLIKNVIRSNYLSPRGINNVKWILDCTKIFHCDKQPRKSYKYPFIEYPMNMDQIIDIFHMCTSTHVGEVVYLIGGWMNNEIHNNAIAVNYISNNWIPIPPMNSPRLYASGIPANNKLYVVGGLPNPTSVERWFHGDAAWVNMPSLLKPRCNPAVASINNVIYVMGGHSETDTTTEYLLPNHDQWQFGPSTYYPHYKSCALVFGRRLFLVGRNAEFYCESSNTWTLIDDPIYPRDNPELIIVDNKLLLIGGFYRESYIDTIEVYNHHTYSWNIWDGK

SEQ ID NO: 491 - protein, 319 aa, synthetic construct
MEPILAPNPNRFVIFPIQYYDIWNMYKKAEASFWTVEEVDISKDINDWNKLTPDEKYFIKHVLAFFAASDGIVNENLAERFCTEVQITEARCFYGFQMAIENIHSEMYSLLIDTYVKDSNEKNYLFNAIETMPCVKKKADWAQKWIHDSAGYGERLIAFAAVEGIFFSGSFASIFWLKKRGLMPGLTFSNELISRDEGLHCDFACLMFKHLLYPPSEETVRSIITDAVSIEQEFLTAALPVKLIGMNCEMMKTYIEFVADRLISELGFKKIYNVTNPFDFMENISLEGKTNFFEKRVGEYQKMGVMSQKDNHFSLDVDF

SEQ ID NO: 492 - protein, 321 aa, synthetic construct
MGTNGVRVFVILYLLAVCGCIEYDVDDNVHICTHTNVSHINHTSWYYNDKVIALATEDKTSGYISSFIKRVNISLTCLNISSLRYEDSGTYKGVSHLKDGVIVTTTMNISVKANIIDLTGRVRYLTRNYCEVKIRCEITSFALNGSTTPPHMILGTVDKWKYLPFPTDDYRYVGELKRYISGNPYPTESLALEISSTFNRFTIVKNLNDNEFSCYLFSQNYSFHKMLNVRNICESKWKALNNNDNASSMPASHNNLANDLFSMMSQLQNDNDDNNDYSAPMNVDNLIMIVLITMLSIILVIIVVIAAISMYKKSKYRHIDN

SEQ ID NO: 493 - protein, 74 aa, synthetic construct
MSKILTFVKNKIIDLINNDQIKYSRVIMIEESDSLLPVDEVHANHGFDCVEMIDENISNENIEQYKTESFFTIN

SEQ ID NO: 494 - protein, 80 aa, synthetic construct
MTLVMGSCCGRFCDAKNKNKKEDVEEGREGCYNYKNLNDLDESEARVEFGPLYMINEEKSDINTLDIKRRYRHTIESVYF

SEQ ID NO: 495 - protein, 65 aa, synthetic construct
MEGSKRKHDSRRLQQEQEQPRPRTPPSYEEIAKYGHSFNVKRFTNKEMCLKNDYPRIISYNPPPK

SEQ ID NO: 496 - protein, 212 aa, synthetic construct
MAETKEFKTLYNLFIDSYLQKLAQHSIPTNVTCAIHIGEVIGQFKNCALRITNKCMSNSRLSFTLMVESFIEVISLLPEKDRRAIAEEIGIDLDDVPSAVSKLEKNCNAYAEVNNIIDIQKLDIGECSAPPGQHMLLQIVNTGSAEANCGLQTIVKSLNKIYVPPIIENRLPYYDPWFLVGVAIILVIFTVAICSIRRNLALKYRYGTFLYV

SEQ ID NO: 497 - protein, 439 aa, synthetic construct
MGVANDSSPEYQWMSPHRLSDTVILGDCLYFNNIMSQLDLHQNWAPSVRLLNYFKNFNRETLLKIEENDYINSSFFQQKDKRFYPINDDFYHISTGGYGIVFKIDNYVVKFVFEATKLYSPMETTAEFTVPKFLYNNLKGDEKKLIVCAWAMGLNYKLTFLHTLYKRVLHMLLLLIQTMDGQELSLRYSSKVFLKAFNERKDSIKFVKLLSHFYPAVINSNINVINYFNRMFHFFEHEKRTNYEYERGNIIIFPLALYSADKVDTELAIKLGFKSLVQYIKFIFLQMALLYIKIYELPCCDNFLHADLKPDNILLFDSNEPIIIHLKDKKFVFNERIKSALNDFDFSQVAGIINKKIKNNFKVKHNWYYDFHFFVHTLLKTYPEIEKDIEFSTALEEFIMCTKTDCDKYRLKVSILHPISFLEKFIMRDIFSDWINGGN

SEQ ID NO: 498 - protein, 348 aa, synthetic construct
MGFCIPLRSKMLKRGSRKSSSILARRPTPKKMNIVTDLENRLKKNSYIENTNQGNILMDSIFVSTMPVETLFGSYITDDSDDYELKDLLNVTYNIKPVIVPDIKLDAVLDRDGNFRPADCFLVKLKHRDGFTKGALYLGHSAGFTATICLKNEGVSGLYIPGTSVIRSNICQGDTIVSRSSRGVQFLPQIGGEAIFLIVSLCPTKKLVETGFVIPEISSNDNAKIAARILSEKRKDTIAHINTLIQYRQQLELAYYNSCMLTEFLHYCNSYAGTIKESLLKETIQKDINITHTNITTLLNETAKVIKLVKSLVDKEDTDIVNNFITKEIKNRDKIVNSLSLSNLDFRL

SEQ ID NO: 499 - protein, 635 aa, synthetic construct
MLNRVQILMKTANNYETIEILRNYLRLYIILARNEEGHGILIYDDNIDSIMSMMNITRLEVIGLTTHCTKLRSSPPIPMSRLFMDEIDHESYYSPKTSDYPLIDIIRKRSHEQGDIALALEQYGIENTDSISEINEWLSSKGLACYRFVKFNDYRKQMYRKFSRCTIVDSMIIGHIGHHYIWIKNLETYTRPEIDVLPFDIKYISRDELWARISSSLDQTHIKTIAVSVYGAITDNGPMPYMISTYPGNTFVNFNSVKDLILYFLDWIKDIMTSTRTIILVGYMSNLFDIPLLTVYWPNNCGWKIYNNTLISSDGARVIWMDAYKFSCGLSLQDYCYHWGSKPESRPFDLIKKSDAKRNSKSLVKESMASLKSLYEAFETQSGALEVLMSPCRMFSFSRIEDMFLTSVINRVSENTGMGMYYPTNDIPFLFIESSICLDYIIVNNQESNKYRIKSVLDIISSKQYPAGRPNYVKNGTKGKLYIALCKVTVPTNDHIPVVYHDDDNTTTFITVLTSVDIETAIRAGYSIVELGALQWDDNIPELKDCLLDSIKMIYDLNAVTTNNLLEQLIENINFNNSSIISLFYTFAISYCRAFIYSIMETIDPVYISQFSYKELYVSSSYKDINESMSQMVKL

SEQ ID NO: 500 - protein, 372 aa, synthetic construct
MWPFASVPAGAKCRLVETLPENMDFRSDHLTTFECFNEIITLAKKYIYIASFCCNPLSTTRGALIFDKLKEASEKGIKIIVLLDERGKRNLGELQSHCPDINFITVNIDKKNNVGLLLGCFWVSDDERCYVGNASFTGGSIHTIKTLGVYSDYPPLATDLRRRFDTFKAFNSAKNSWLNLCSAACCLPVSTAYHIKNPIGGVFFTDSPEHLLGYSRDLDTDVVIDKLRSAKTSIDIEHLAIVPTTRVDGNSYYWPDIYNSIIEAAINRGVKIRLLVGNWDKNDVYSMATARSLDALCVQNDLSVKVFTIQNNTKLLIVDDEYVHITSANFDGTHYQNHGFVSFNSIDKQLVSEAKKIFERDWVSSHSKSLKI

SEQ ID NO: 501 - protein, 73 aa, synthetic construct
MKHRLYSEGLSISNDLNSIIGQQSTMDTDIEINEDDIMELLNILTELGCDVDFDENFSDIADDILESLIEQDV

SEQ ID NO: 502 - protein, 49 aa, synthetic construct
MVIGLVIFVSVAAAIVGVLSNVLDMFMYVEENNEEDARIKEEQELLLLY

SEQ ID NO: 503 - protein, 158 aa, synthetic construct
MRSIAGLHKLKMEIFNVEELINMKPFKNMNKITINQKDNCILANRCFVKIDTPRYIPSTSISSSNIIRIRNHDFTLSELLYSPFHFQQPQFQYLLPGFVLTCIDKVSKQQKECKYCISNRGDDDSLSINLFIPTINKSIYIIIGLRMKNFWKPKFEIE

SEQ ID NO: 504 - protein, 231 aa, synthetic construct
MKVVIVTSVASLLDASIQFQKTACRHHCNYLSMQVVKEIEEFGTINEKNLEFDTWKDVIQNDEIDALVFYRVKQISISTGVLYKSMMRNRTKPISMYFVRDCLAFDGDPPSFRMTSCNINAYNRNKIKDLIILMNMKTCNKKIIGEFIIDNFGSVDALLSIINSNVTWITSVINNSNGRGINIRVSNNKMLTITSFRRFVNKLKMYKTTKCASQLDNLCTEMNKMDIIDKK

SEQ ID NO: 505 - protein, 101 aa, synthetic construct
MNSHFASAHTPFYINTKEGRYLVLKAVKVCDVRTVECEGSKASCVLKVDKPSSPACERRPSSPSRCERMNNPGKQVPFMRTDMLQNMFAANRDNVASRLLS

SEQ ID NO: 506 - protein, 479 aa, synthetic construct
MNRNPDQNTFPNITLKIIETYLGRVPSVNEYHMLKLQARNIQKITVFNKDIFVSLVKKNKKRFFSDVNTSASEIKDRILSYFSKQTQTYNIGKLFTIIELQSVLVTTYTDILGVLTIKAPNVISSKISYNVTSMEELARDMLNSMNVAVIDKAKVMGRHNVSSLVKNVNKLMEEYLRRHNKSCICYGSYSLYLINPNILYGDIDILQTNSRTFLIDLAFLIKFITGNNIILSKIPYLRNYMVIKDENDNHIIDSFNIRQDTMNVVPKIFIDNIYIVDPTFQLLNMIKMFSQIDRLEDLSKDPEKFNARMATMLEYVRYTHGIVFDGKRNNMPMKCIIDENNRIVTVTTKDYFSFKKCLVYLDENVLSSDILDLNADTSCDFESVTNSVYLIHDNIMYTYFSNTILLSDKGKVHEISARGLCAHILLYQMLTSGEYKQCLSDLLNSMMNRDKIPIYSHTERDKKPGRHGFINIEKDIIVF

SEQ ID NO: 507 - protein, 737 aa, synthetic construct
MISVTDIRRAFLDNECHTITKAFGYLHEDKAIALIKIGFHPTYLPKVLYNNVVEFVPEKLYLFKPRTVAPLDLISTITKLKNVDKFASHINYHKNSILITGDKSLIVKCMPYMIISDDDIRFIREQFVGTNSIEYILSFINKESIYRMSYQFSENEIVTIINRDHFMYEPIYEHQVLDSDFLKTMLDRYGIVPINSGIIDELCPEAIIEILMAVVRPRDAIRFLDIVNKNQLTEDSVKNYIINDIRRGKIDYYIPYVEDFLEDRTEDLGIYANIFFEDAIDITKLDITKTELEHISKYMNYYTTYIDHIVNIILQNNYIDILASIIDYVQDVLTEELCIRIVCESTNPVPVTSLPIHSTLVMVMCIQMKYVDIVEFLDEIDIDTLIEKGADPITEYTFTTRWYNKHNDLITLYIKKYGFCPMMMKRLMFEYPLTKEASDHLLKTMDENRGAIMFFPRTICTLPYLLCCNYKLIQKPIPFKEENRNIVYKKNNRVLCFDSLENSAFKSLIKIDSIPGLKTYNMKDITYEKSNNIICVRFIPQESIHNEERRIKLQLFDIARLASYGLYYIPSRYLSSWTPVVNMIEGREYTNPQKIECLVILDLFSEEFIEYQNLGNAVSNKYELEYTISNYQAAINCLMSTLLIYLVLGSIRSISKTEDFVLSILNIFYKGLKINELLSEPVSGVCIELDKIKDRASSGDSSFIFLKKNELSKTLSLCEKVCVETILDNNQSFKSSK

SEQ ID NO: 508 - protein, 190 aa, synthetic construct
MSKIYIDERSDAEIVCAAIKNIGIEGATAAQLTRQLNMEKREVNKALYDLQRSAMVYSSDDIPPRWFMTTEADKPDADVMADAIIDDVSREKSMREDHKSFDDVIPAKKIIDWKDANPVTIINEYCQITKRDWSFRIESVGPSNSPTFYACVDIDGRVFDKADGKSKRDAKNNAAKLAVDKLLGYVIIRF

SEQ ID NO: 509 - protein, 259 aa, synthetic construct
MENVYISSYSSNEQTSMAVAATDIRELLSQYVDDANLEDLIEWAMEKSSKYYIKNIGNTKSNIEETKFESKNNIGIEYSKDSRNKLSYRNKPSIATNLEYKTLCDMIKGTSGTEKEFLRYLLFGIKCIKKGVEYNIDKIKDVSYNDYFNVLDEKYNTPCPNCKSRNTTPMMIQTRAADEPPLVRHACRDCKQHFKPPKFRAFRNLNVTTQSIHENKEITEILPDNNPSPPESPEPASPIDDGLIRSTFDRNDEPPEDDE

SEQ ID NO: 510 - protein, 331 aa, synthetic construct
MLIIVLWLYGYNFIMSESQCPMINDDSFTLKRKYQIDSAESTIKMDKKRIKFQNRAKMVKEINQTIRAAQTHYETLKLGYIKFKRMIRTTTLEDIAPSIPNNQKTYKLFSDISAIGKASQNPSKMVYALLLYMFPNLFGDDHRFIRYRMHPMSKIKHKIFSPFKLNLIRILVEERFYNNECRSNKWKIIGTQVDKMLIAESDKYTIDARYNLKPMYRIKGESEEDTLFIKQMVEQCVTSQELVEKVLKILFRDLFKSGEYKAYRYDDDVENGFIGLDTLKLNIVHDIVEPCMPVRRPVAKILCKEMVNKYFENPLHIIGKNLQECIDFVSE

SEQ ID NO: 511 - protein, 567 aa, synthetic construct
MDFIRRKYLIYTVENNIDFLKDDTLSKVNNFTLNHVLALKYLVSNFPQHVITKDVLANTNFFVFIHMVRCCKVYEAVLRHAFDAPTLYVKALTKNYLSFSNAIQSYKETVHKLTQDEKFLEVAEYMDELGELIGVNYDLVLNPLFHGGEPIKDMEIIFLKLFKKTDFKVVKKLSVIRLLIWAYLSKKDTGIEFADNDRQDIYTLFQQTGRIVHSNLTETFRDYIFPGDKTSYWVWLNESIANDADIVLNRHAITMYDKILSYIYSEIKQGRVNKNMLKLVYIFEPEKDIRELLLEIIYDIPGDILSIIDAKNDDWKKYFISFYKANFINGNTFISDRTFNEDLFRVVVQIDPEYFDNERIMSLFSTSAADIKRFDELDINNSYISNIIYEVNDITLDTMDDMKKCQIFNEDTSYYVKEYNTYLFLHESDPMVIENGILKKLSSIKSKSRRLNLFSKNILKYYLDGQLARLGLVLDDYKGDLLVKMINHLKSVEDVSAFVRFSTDKNPSILPSLIKTILASYNISIIVLFQRFLRDNLYHVEEFLDKSIHLTKTDKKYILQLIRHGRS

SEQ ID NO: 512 - protein, 166 aa, synthetic construct
MGTAATIQTPTKLMNKENAEMILEKIVDHIVMYISDESSDSENNPEYIDFRNRYEDYRSLIIKSDHEFVKLCKNHAEKSSPETQQMIIKHIYEQYLIPVSEVLLKPIMSMGDIITYNGCKDNEWMLEQLSTLNFNNLRTWNSCSIGNVTRLFYTFFSYLMKDKLNI

SEQ ID NO: 513 - protein, 273 aa, synthetic construct [sequence omitted]

SEQ ID NO: 514 - protein, 1006 aa, synthetic construct
MDVRCINWFESHGENRFLYLKSRCRNGETVFIRFPHYFYYVVTDEIYQSLSPPPFNARPLGKMRTIDIDETISYNLDIKDRKCSVADMWLIEEPKKRSIQNATMDEFLNISWFYISNGISPDGCYSLDEQYLTKINNGCYHCDDPRNCFAKKIPRFDIPRSYLFLDIECHFDKKFPSVFINPISHTSYCYIDLSGKRLLFTLINEEMLTEQEIQEAVDRGCLRIQSLMEMDYERELVLCSEIVLLRIAKQLLELTFDYVVTFNGHNFDLRYITNRLELLTGEKIIFRSPDKKEAVHLCIYERNQSSHKGVGGMANTTFHVNNNNGTIFFDLYSFIQKSEKLDSYKLDSISKNAFSCMGKVLNRGVREMTFIGDDTTDAKGKAAAFAKVLTTGNYVTVDEDIICKVIRKDIWENGFKVVLLCPTLPNDTYKLSFGKDDVDLAQMYKDYNLNIALDMARYCIHDACLCQYLWEYYGVETKTDAGASTYVLPQSMVFEYRASTVIKGPLLKLLLETKTILVRSETKQKFPYEGGKVFAPKQKMFSNNVLIFDYNSLYPNVCIFGNLSPETLVGVVVSTNRLEEEINNQLLLQKYPPPRYITVHCEPRLPNLISEIAIFDRSIEGTIPRLLRTFLAERARYKKMLKQATSSTEKAIYDSMQYTYKIVANSVYGLMGFRNSALYSYASAKSCTSIGRRMILYLESVLNGAELSNGMLRFANPLSNPFYMDDRDINPIVKTSLPIDYRFRFRSVYGDTDSVFTEIDSQDVDKSIEIAKELERLINNRVLFNNFKIEFEAVYKNLIMQSKKKYTTMKYSASSNSKSVPERINKGTSETRRDVSKFHKNMIKTYKTRLSEMLSEGRMNSNQVCIDILRSLETDLRSEFDSRSSPLELFMLSRMHHSNYKSADNPNMYLVTEYNKNNPETIELGERYYFAYICPANVPWTKKLVNIKTYETIIDRSFKLGSDQRIFYEVYFKRLTSEIVNLLDNKVLCISFFERMFGSKPTFYEA

SEQ ID NO: 515 - protein, 95 aa, synthetic construct
MNPKHWGRAVWTIIFIVLSQAGLDGNIEACKRKLYTIVSTLPCPACRRHATIAIEDNNVMSSDDLNYIYYFFIRLFNNLASDPKYAIDVTKVNPL

SEQ ID NO: 516 - protein, 129 aa, synthetic construct
MELVNIFLETDAGRVKFAIKNTDDVCASELINKFVELLSEYIHIDQSEFYLVVKDKDIFYFKCDRGSISIVNNEFYVFDEPLLFVKDFTNVTGVEFIVTETMPCRIIPKNNHAVISVVTNHKFYNGLSL

SEQ ID NO: 517 - protein, 666 aa, synthetic construct
MFMYPEFARKALSKLISKKLNIEKVSSKHQLVLLDYGLHGLLPKSLYLEAINSDILNVRFFPPEIINVTDIVKALQNSCRVDEYLKSVSLYHKNSLMVSGPNVVKLMIEYNLLTHSDLEWLINENVVKATYLLKINAYMINFKIDLTVDEIIDLVKDIPVGATLHLYNILNNIDLDIVLRISDEYNIPPVHDILSKLTDEEMCIKLVTKYPMDNVINFINQDVRYSPTFIKTIKDFVNEHLPTMYDGLNDYLHSVIIDEDLIEEYKIKSVAMFNLEYKTDVNTLTLDEQIFVEVNISYYDFRYRQFADEFRDYIMIKERRQITMQSGDRIRRFRRPMSLRSTIIKKDTDSLEDILAHIDNARKNSKVSIEDVERIISSFRLNPCVVRRTMLSDIDIKTKIMVLKIVKDWKSCALTLSAIKGIMVTDTINTVLSKILHHHRNVFKYLTSVENKEIAVCNCSRCLSLFYRELKSVRCDLRTDDGLLDRLYDLTRYALHGKINQNLIGQRCWGPLTEMLFNENKKKKLNNLMEYIKISDMLVYGHSIEKTLIPITDSLSFKLSVDTMSVLNDQYAKVVIFFNTIIEYIIATIYYRLTVLNNYTNVKHFVSKVLHTVMEACGVLFSYIKVNDKIEHELEEMVDKGTVPSYLYHLSINVISIILDDINGTR

SEQ ID NO: 518 - protein, 108 aa, synthetic construct
MAEEFVQQRLANNKVTIFVKYTCPFCRNALDILNKFSFKRGAYEIVDIKEFKPENELRDYFEQITGGRTVPRIFFGKTSIGGYSDLLEIDNMDALGDILSSIGVLRTC

SEQ ID NO: 519 - protein, 312 aa, synthetic construct
MAEFEDQLVFNSISARALKAYFTAKINEMVDELVTRKCPQKKKSQAKKPEVRIPVDLVKSSFVKKFGLCNYGGILISLINSLVENNFFTKDGKLDDTGKKELVLTDVEKRILNTIDKSSPLYIDISDVKVLAARLKRSATQFNFNGHTYHLENDKIEDLINQLVKDESIQLDEKSSIKDSMYVIPDELIDVLKTRLFRSPQVKDNIISRTRLYDYFTRVTKRDESSIYVILKDPRIASILSLETVKMGAFMYTKHSMLTNAISSRVDRYSKKFQESFYEDIAEFVKENERVNVSRVVECLTVPNITISSNAE

SEQ ID NO: 520 - protein, 73 aa, synthetic construct
MDKLYAAIFGVFMGSPEDDLTDFIEIVKSVLSDEKTVTSTNNTGCWGWYWLIIIFFIVLILLLLIYLYLKVVW

SEQ ID NO: 521 - protein, 269 aa, synthetic construct
MSKVIKKRVETSPRPTASSDSLQTCAGVIEYAKSISKSNAKCIEYVTLNASQYANCSSISIKLTDSLSSQMTSTFIMLEGETKLYKNKSKQDRSDGYFLKIKVTAASPMLYQLLEAVYGNIKHKERIPNSLHSLSVETITEKTFKDESIFINKLNGAMVEYVSTGESSILRSIEGELESLSKRERQLAKAIITPVVFYRSGTETKITFALKKLIIDREVVANVIGLSGDSERVSMTENVEEDLARNLGLVDIDDEYDEDSDKEKPIFNV

SEQ ID NO: 522 - protein, 771 aa, synthetic construct
MFVIKRNGYKENVMFDKITSRIRKLCYGLNTDHIDPIKIAMKVIQGIYNGVTTVELDTLAAEIAATCTTQHPDYAILAARIAVSNLHKETKKLFSEVMEDLFNYVNPKNGKHSPIISSITMDIVNKYKDKLNSVIIYERDFSYNYFGFKTLEKSYLLKINNKIVERPQHMLMRVAVGIHQWDIDSAIETYNLLSEKWFTHASPTLFNAGTSRHQMSSCFLLNMIDDSIEGIYDTLKRCALISKMAGGIGLSISNIRASGSYISGTNGISNGIIPMLRVYNNTARYIDQGGNKRPGVMAIYLEPWHSDIMAFLDLKKNTGNEEHRTRDLFIALWIPDLFMKRVKDDGEWSLMCPDECPGLDNVWGDEFERLYTLYERERRYKSIIKARVVWKAIIESQIETGTPFILYKDACNKKSNQQNLGTIKCSNLCTEIIQYADANEVAVCNLASVALNMFVIDGRFDFLKLKDVVKVIVRNLNKIIDINYYPIPEAEISNKRHRPIGIGVQGLADAFILLNYPFDSLEAQDLNKKIFETIYYGALEASCELAEKEGPYDTYVGSYASNGILQYDLWNVVPSDLWNWEPLKDKIRTYGLRNSLLVAPMPTASTAQILGNNESVEPYTSNIYTRRVLSGEFQVVNPHLLRVLTERKLWNDEIKNRIMADGGSIQNTNLPEDIKRVYKTIWEIPQKTIIKMAADRGAFIDQSQSMNIHIADPSYSKLTSMHFYGWSLGLKTGMYYLRTKPASAPIQFTLDKDKIKPPVVCDSEICTSCSG

SEQ ID NO: 523 - protein, 79 aa, synthetic construct
MVDAITVLTAIGITVLMLLMVISGAALIVKELNPNDIFTMQSLKFNRAVTIFKYIGLFIYIPGTIILYATYVKSLLMKS

SEQ ID NO: 524 - protein, 382 aa, synthetic construct
MNNFVKQVASKSLKPTKKLSPSDEVISLNECIISFNLDNFYYCNDVLFTKPINTPEDVLKSLLIMESFAYEKMIIKGLIKILIFRAYINDIYFTPFGWLTGVDDDPETHVVIKIIFNSSLISIKSQVIEYLKPYNVNNLSVLTTEKELSINTFNVPDSIPMSIISFFPFDTDFILVILFFGVYNDSYCGISYISPKERLPYIIEILKPLVSEINMLSDEIGRTSSIRIFNSTSVKKFPTNTLTSICEIVYSFDESSFPTPKTFTPLNASPYIPKKIVSLLDLPSNVEIKAISRGGVDFITHINNKRLNTILVIAKDNFLKNSTFSGTFIKENIIWKGIYTYRIIKSSFPVPTIKSVTNKKKICKKHCFVNSQYTTRTLSHIL

SEQ ID NO: 525 - protein, 423 aa, synthetic construct
MERYTDLVISKIPELGFTNLLCHIYSLAGLCSNIDVSKFLTNCNGYVVEKYDKSTTAGKVSCIPIGMMLELVELGHLSRPNSSDELDQKKELTDELKTRYHSIYDVFELPTSIPLAYFFKPRLREKVSKAIDFSQMDLKIDDLSRKGIHTGENPKVVKMKIEPERGAWMSNRSIKNLVSQFAYGSEVDYIGQFDMRFLNSLAIHEKFDAFMNKHILSYILKDKIKSSTSRFVMFGFCYLSHWKCVIYDKKQCLVSFYDSGGNIPTEFHHYNNFYFYSFSDGFNTNHRHSVLDNTNCDIDVLFRFFECTFGAKIGCINVEVNQLLESECGMFISLFMILCTRTPPKSFKSLKKVYTFFKFLADKKMTLFKSILFNLHDLSLDITETDNAGLKEYKRMEKWTKKSINVICDKLTTKLNRIVNDDE

SEQ ID NO: 526 - protein, 676 aa, synthetic construct
MEKNLPDIFFFPNCVNVFSYKYSQDEFSNMSKTERDSFSLAVFPVIKHRWHNAHVVKHKGIYKVSTEARGKKVSPPSLGKPAHINLTAKQYIYSEHTISFECYSFLKCITNTEINSFDEYILRGLLEAGNSLQIFSNSVGKRTDTIGVLGNKYPFSKIPLASLTPKAQREIFSAWISHRPVVLTGGTGVGKTSQVPKLLLWFNYLFGGFSTLDKITNFHERPVILSLPRIALVRLHSNTILKSLGFKVLDGSPISLRYGSIPEELINKQPKKYGIVFSTHKLSLTKLFSYGTLIIDEVHEHDQIGDIIIAVARKHHTKIDSMFLMTATLEDDRERLKVFLPNPAFIHIPGDTLFKISEVFIHNKINPSSRMAYIEEEKRNLVTAIQMYTPPDGSSGIVFVASVAQCHEYKSYLEKRLPYDMYIIHGKVLDIDEILEKVYSSPNVSIIISTPYLESSVTIRNVTHIYDMGKVFVPAPFGGSQEFISKSMRDQRKGRVGRVNPGTYVYFYDLSYMKSIQRIDSEFLHNYILYANKFNLTLPEDLFIIPTNLDILWRTKEYIDSFDISTETWNKLLSNYYMKMIEYAKLYVLSPILAEELDNFERTGELTSIVREAILSLNLRIKILNFKHKDDDTYIHFCKILFGVYNGTNATIYYHRPLTGYMNMISDTIFVPVDNN

SEQ ID NO: 527 - protein, 591 aa, synthetic construct
MIVLPNKVRIFINDRMKKDIYLGISNFGFENDIDEILGIAHLLEHLLISFDSTNFLANASTSRSYMSFWCKSINSATESDAIRTLVSWFFSNGKLKDNFSLSSIRFHIKELENEYYFRNEVFHCMDILTFLSGGDLYNGGRIDMIDNLNIVRDMLVNRMQRISGSNIVIFVKRLGPGTLDFFKQTFGSLPACPEIIPSSIPVSTNGKIVMTPSPFYTVMVKINPTLDNILGILYLYETYHLIDYETIGNQLYLTVSFIDETEYESFLRGEAILQISQCQSINMNYSDDYMMNIYLNFPWLSHDLYDYITRINDDSKSILISLTNEIYASIINRDIIVIYPNFSKAMCNTRDTQQHPIVVLDATNDGLIKKPYRSIPLMKRLTSNEIFIRYGDASLMDMITLSLSKQDISLKRNAEGIRVKHSFSADDIQAIMESDSFLKYSRSKPAAMYQYIFLSFFASGNSIDDILANRDSTLEFSKRTKSKILFGRNTRYDVTAKSSFVCGIVRGKSLDKTSLVEMMWDLKKKGLIYSMEFTNLLSKNTFYLFTFTIYTDEVYDYLNTNKLFSAKCLVVSTKGDVENFSSLKKDVVIRV

SEQ ID NO: 528 - protein, 111 aa, synthetic construct
MASLLYLILFLLFVCISYYFTYYPTNKLQAAVMETDRENAIIRQRNDEIPTRTLDTAIFTDASTVASAQIHLYYNSNIGKIIMSLNGKKHTFNLYDDNDIRTLLPILLLSK

SEQ ID NO: 529 - protein, 220 aa, synthetic construct
MPFRDLILFNLSKFLLTEDEESLEIVSSLCRGFEISYDDLITYFPDRKYHKYISKVFEHVDLSEELSMEFHDTTLRDLVYLRLYKYSKCIRPCYKLGDNLKGIVVIKDRNIYIREANDDLIEYLLKEYTPQIYTYSNERVPITGSKLILCGFSQVTFMAYTTSHITTNKKVDVLVSKKCIDELVDPINYQILQNLFDKGSGTINKILRKIFYSVTGGQTP

SEQ ID NO: 530 - protein, 124 aa, synthetic construct
MKNVLIIFGKPYCSICENVSDAVEELKSEYDILHVDILSFFLKDGDSSMLGDVKRGTLIGNFAAHLSNYIVSIFKYNPQTKQMAFVDINKSLDFTKTDKSLVNLEILKSEIEKANYGVWPPVTE

SEQ ID NO: 531 - protein, 434 aa, synthetic construct
MGIKNLKSLLLENKSLTILDDNLYKVYNGIFVDTMSIYIAVANCVRNLEELTTVFIKYVNGWVKKGGHVTLFIDRGSIKIKQDVRDKRRKYSKLTKDRKMLELEKCTSEIQNVTGFMEEEIKAEMQLKIDKLTFQIYLSDSDNIKISLNEILTHFNNNENVTLFYCDERDAEFVMCLEAKTHFSTTGEWPLIISTDQDTMLFASTDNHPKMIKNLTQLFKFVPSAEDNYLAKLTALVNGCDFFPGLYGASITPTNLNKIQLFSDFTIDNIVTSLAIKNYYRKTNSTVDVRNIVTFINDYANLDDVYSYVPPCQCTVQEFIFSALDEKWNNFKSSYLETVPLPCQLMYALEPRKEIDVSEVKTLSSYIDFENTKSDIDVIKSISSIFGYSNENCNTIVFGIYKDNLLLSINSSFYFNDSLLITNTKSDNIINIGY

SEQ ID NO: 532 - protein, 63 aa, synthetic construct
MVFQLVCSTCGKDISHERYKLIIRKKSLKDVLVSVKNECCRLKLSTQIEPQRNLTVQPLLDIN

SEQ ID NO: 533 - protein, 165 aa, synthetic construct
MDPVNFIKTYAPRGSIIFINYTMSLTSHLNPSIEKHVGIYYGTLLSEHLVVESTYRKGVRIVPLDSFFEGYLSAKVYMLENIQVMKIAADTSLTLLGIPYGFGHDRMYCFKLVAECYKNAGIDTSSKRILGKDIFLSQNFTDDNRWIKIYDSNNLTFWQIDYLKG

SEQ ID NO: 534 - protein, 371 aa, synthetic construct
MAAEQRRSTIFDIVSKCIVQSVLRDISINSEYIESKAKQLCYCPASKKESVINGIYNCCESNIEIMDKEQLLKILDNLRCHSAHVCNATDFWRLYNSLKRFTHTTAFFNTCKPTILATLNTLITLILSNKLLYAAEMVEYLENQLDSSNKSMSQELAELLEMKYALINLVQYRILPMIIGEPIIVAGFSGKEPISDYSAEVERLMELPVKTDIVNTTYDFLARKGIDTSNNIAEYIAGLKIEEIEKVEKYLPEVISTIANSNIIKNKKSIFPANINDKQIMECSRMLDTSEKYSKGYKTDGAVTSPLTGNNTITTFIPISASDMQKFTILEYLYIMRVMANNVKKKNEGKNNGGVVMHINSPFKVINLPKC

SEQ ID NO: 535 - protein, 260 aa, synthetic construct
MSIRIKIDKLRQIVAYFSEFSEEVSINVDSTDELMYIFAALGGSVNIWAIIPLSASVFYRGAENIVFNLPVSKVKSCLCSFHNDAIIDIEPDLENNLVKLSSYHVVSVDCNKELMPIRTDTTICLSIDQKKSYVFNFHKYEEKCCGRTVIHLEWLLGFIKCISQHQHLAIMFKDDNIIMKTPGNTDAFSREYSMTECSQELQKFSFKIAISSLNKLRGFKKRVNVFETRIVMDNDDNILGMLFSDRVQSFKINIFMTFLD

SEQ ID NO: 536 - protein, 340 aa, synthetic construct
MGGGVSVELPKRDPPPGVPTDEMLLNVDKMHDVIAPAKLLEYVHIGPLAKDKEDKVKKRYPEFRLVNTGPGGLSALLRQSYNGTAPNCCRTFNRTHYWKKDGKISDKYEEGAVLESCWPDVHDTGKCDVDLFDWCQGDTFDRNICHQWIGSAFNRSNRTVEGQQSLINLYNKMQTLCSKDASVPICESFLHHLRAHNTEDSKEMIDYILRQQSADFKQKYMRCSYPTRDKLEESLKYAEPRECWDPECSNANVNFLLTRNYNNLGLCNIVRCNTSVNNLQMDKTSSLRLSCGLSNSDRFSTVPVNRAKVVQHNIKHSFDLKLHLISLLSLLVIWILIVAI

SEQ ID NO: 537 - protein, 250 aa, synthetic construct
MGAAASIQTTVNTLSERISSKLEQEANASAQTKCDIEIGNFYIRQNHGCNLTVKNMCSADADAQLDAVLSAATETYSGLTPEQKAYVPAMFTAALNIQTSVNTVVRDFENYVKQTCNSSAVVDNKLKIQNVIIDECYGAPGSPTNLEFINTGSSKGNCAIKALMQLTTKATTQIAPKQVAGTGVQFYMIVIGVIILAALFMYYAKRMLFTSTNDKIKLILANKENVHWTTYMDTFFRTSPMVIATTDMQN

SEQ ID NO: 538 - protein, 87 aa, synthetic construct
MEVITDRLDDIVKQNIADEKFVDFVIHGLEHQCPAILRPLIRLFIDILLFVIVIYIFTVRLVSRNYQMLLALVALVITLTIFYYFIL

SEQ ID NO: 539 - protein, 350 aa, synthetic construct
MNTRTDVTNDNIDKNPTKRGDKNIPGRNERFNDQNRFNNDIPKPKPRLQPNQPPKQDNKCREENGDFINIRLCAYEKEYCNDGYLSPAYYMLKQVDDEEMSCWSELSSLVRSRKAVGFPLLKAAKRISHGSMLYFEQFKNSKVVRLTPQVKCLNDTVIFQTVVILYSMYKRGIYSNEFCFDLVSIPRTNIVFSVNQLMFNICTDILVVLSICGNRLYRTNLPQSCYLNFIHGHETIARRGYEHSNYFFEWLIKNHISLLTKQTMDILKVKKKYAIGAPVNRLLEPGTLVYVPKEDYYFIGISLTDVSISDNVRVLFSTDGIVLEIEDFNIKHLFMAGEMFVRSQSSTIIV

SEQ ID NO: 540 - protein, 251 aa, synthetic construct
MSLLLENLIEEDTIFFAGSISEYDDLQMVIAGAKSKFPRSMLSIFNIVPRTMSKYELELIHNENITGAMFTTMYNIRNNLGLGDDKLTIEAIENYFLDPNNEVMPLIINNTDMTAVIPKKSGRRKNKNMVIFRQGSSPILCIFETRKKINIYKENMESASTEYTPIGDNKALISKYAGINVLNVYSPSTSMRLNAIYGFTNKNKLEKLSTNKELESYSSSPLQEPIRLNDFLGLLECVKKNIPLTDIPTKD

SEQ ID NO: 541 - protein, 128 aa, synthetic construct
MENVPNVYFNPVFIEPTFKHSLLSVYKHRLIVLFEVFVVFILIYVFFRSELNMFFMPKRKIPDPIDRLRRANLACEDDKLMIYGLPWMTTQTSALSINSKPIVYKDCAKLLRSINGSQPVSLNDVLRR

SEQ ID NO: 542 - protein, 153 aa, synthetic construct
MDHNQYLLTMFFADDDSFFKYLASQDDESSLSDILQITQYLDFLLLLLIQSKNKLEAVGHCYESLSEEYRQLTKFTDFQDFKKLFNKVPIVTDGRVKLNKGYLFDFVISLMRFKKESSLATTAIDPIRYIDPRRDIAFSNVMDILKSNKVNNN

SEQ ID NO: 543 - protein, 333 aa, synthetic construct
MDVVSLDKPFMYFEEIDNELDYEPESANEVAKKLPYQGQLKLLLGELFFLSKLQRHGILDGATVVYIGSAPGTHIRYLRDHFYNLGVIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKLDAVNYEKKMYYLNKIVRNKVVVNFDYPNQEYDYFHMYFMLRTVYCNKTFPTTKAKVLFLQQSIFRFLNIPTTSTEKVSHEPIQRKISSKNSMSKNRNSKRSVRGNK

SEQ ID NO: 544 - protein, 185 aa, synthetic construct
MNQYNVKYLAKILCLKTEIARDPYAVINRNVLLRYTTDIEYNDLVTLITVRHKIDSMKTVFQVFNESSINYTPVDDDYGEPIIITSYLQKGHNKFPVNFLYIDVVISDLFPSFVRLDTTETNIVNSVLQTGDGKKTLRLPKMLETEIVVKILYRPNIPLKIVRFFRNNMVTGVEIADRSVISVAD

SEQ ID NO: 545 - protein, 133 aa, synthetic construct
MTDEQIYAFCDANKDDIRCKCIYPDKSIVRIGIDTRLPYYCWYEPCKRSDALLPASLKKNITKCNVSDCTISLGNVSITDSKLDVNNVCDSKRVATENIAVRYLNQEIRYPIIDIKWLPIGLLALAILILAFF

SEQ ID NO: 546 - protein, 1286 aa, synthetic construct
MAVISKVTYSLYDQKEINATDIIISHVKNDDDIGTVKDGRLGAMDGALCKTCGKTELECFGHWGKVSIYKTHIVKPEFISEIIRLLNHICIHCGLLRSREPYSDDINLKELSGHALRRLKDKILSKKKSCWNSECMQPYQKITFSKKKVCFVNKLDDINVPNSLIYQKLISIHEKFWPLLEIHQYPANLFYTDYFPIPPLIIRPAISFWIDSIPKETNELTYLLGMIVKNCNLNADEQVIQKAVIEYDDIKIISNNTTSINLSYITSGKNNMIRSYIVARRKDQTARSVIGPSTSITVNEVGMPAYIRNTLTEKIFVNAFTVDKVKQLLASNQVKFYFNKRLNQLTRIRQGKFIKNKIHLLPGDWVEVAVQEYTSIIFGRQPSLHRYNVIASSIRATEGDTIKISPGIANSQNADFDGDEEWMILEQNPKAVIEQSILMYPTTLLKHDIHGAPVYGSIQDEIVAAYSLFRIQDLCLDEVLNILGKYGREFDPKGKCKFSGKDIYTYLIGEKINYPGLLKDGEIIANDVDSNFVVAMRHLSLAGLLSDHKSNVEGINFIIKSSYVFKRYLSIYGFGVTFKDLRPNSTFTNKLEAINVEKIELIKEAYAKYLNDVRDGKIVPLSKALEADYVESMLSNLTNLNIREIEEHMRQTLIDDPDNNLLKMAKAGYKVNPTELMYILGTYGQQRIDGEPAETRVLGRVLPYYLPDSKDPEGRGYILNSLTKGLTGSQYYFSMLVARSQSTDIVCETSRTGTLARKIIKKMEDMVVDGYGQVVIGNTLIKYAANYTKILGSVCKPVDLIYPDESMTWYLEISALWNKIKQGFVYSQKQKLAKKTLAPFNFLVFVKPTTEDNAIKVKDLYDMIHNVIDDVREKYFFTVSNIDFMEYIFLTHLNPSRIRITKETAITIFEKFYEKLNYTLGGGTPIGIISAQVLSEKFTQQALSSFHTTEKSGAVKQKLGFNEFNNLTNLSKNKTEIITLVSDDISKLQSVKINFEFVCLGELNPDITLRKETDRYVVDIIVNRLYIKRAEITELVVEYMIERFISFSVIVKEWGMETFIEDEDNIRFTVYLNFVEPEELNLSKFMMVLPGAANKGKISKFKIPISDYTGYDDFNQTKKLNKMTVELMNLKELGSFDLENVNVYPGVWNTYDIFGIEAAREYLCEAMLNTYGEGFDYLYQPCDLLASLLCASYEPESVNKFKFGAASTLKRATFGDNKALLNAALHKKSEPINDNSSCHFFSKVPNIGTGYYKYFIDLGLLMRMERKLSDKISSQKIKEMEETEDF

SEQ ID NO: 547 - protein, 171 aa, synthetic construct
MDKKSLYKYLLLRSTGDMHRAKSPTIMTRVTNNVYLGNYKNAMDAPSSEVKFKYVLNLTMDKYTLPNSNINIIHIPLVDDTTTDISKYFDDVTAFLSKCDQRNEPVLVHCAAGVNRSGAMILAYLMSKNKESLPMLYFLYVYHSMRDLRGAFVENPSFKRQIIEKYVIDKN

SEQ ID NO: 548 - protein, 189 aa, synthetic construct
MDKTTLSVNACNLEYVREKAIVGVQAAKTSTLIFFVIILAISALLLWFQTSDNPVFNELTRYMRIKNTVNDWKSLTDSKTKLESDRGRLLAAGKDDIFEFKCVDFGAYFIAMRLDKKTYLPQAIRRGTGDAWMVKKAAKVDPSAQQFCQYLIKHKSNNVITCGNEMLNELGYSGYFMSPHWCSDFSNME

SEQ ID NO: 549 - protein, 324 aa, synthetic construct
MAAAKTPVIVVPVIDRLPSETFPNVHEHINDQKFDDVKDNEVMPEKRNVVVVKDDPDHYKDYAFIQWTGGNIRNDDKYTHFFSGFCNTMCTEETKRNIARHLALWDSNFFTELENKKVEYVVIVENDNVIEDITFLRPVLKAMHDKKIDILQMREIITGNKVKTELVMDKNHAIFTYTGGYDVSLSAYIIRVTTALNIVDEIIKSGGLSSGFYFEIARIENEMKINRQILDNAAKYVEHDPRLVAEHRFENMKPNFWSRIGTAATKRYPGVMYAFTTPLISFFGLFDINVIGLIVILFIMFMLIFNVKSKLLWFLTGTFVTAFI

SEQ ID NO: 550 - protein, 795 aa, synthetic construct
MDSKETILIEIIPKIKAYLLDANISPKSYDDFISRNKNIFVINLYNVSTITEEDIRLLYTTIEQNIDADDQTLVAIFSYIGYKFEQAVKEEISTSLSFNDKNTTDEMTYNLYDLFFNTLDMYLRQKKISILVNDDVRGDVIVSYKNSDLVSSFNAELEPEIKKIPFNMKNLLPYLEKNLDQLRFSKKYLDFAYLCRHIGIPISKKKYNVRYVFLYKIDGLSIPIIIKDFLDVKYVYLENTGKIYKNSFSEDHNNSLSDWGKVIIPLLKDRHLYSYIFLSSYHLHSYYTDLIARDEPVFVKRKKLDIIEIDEPEAWKRDVRVEFAPCEHQIRLKEAMKVDANYFTKINNFANEFIYYEDGVAYCRVCGINIPIFNLDAADVIKNTVIVSTFNKTIFLSEPYSYFVHSQRFIFNIIMSFDNIMKSQTWVMKYNINRLILNFLIDINSRRQEYEKKFSSEIKRGLFFLRLSANLFESQVSSTELFYVSKMLNLNYIVALVIILNSSADFIVSYMTSKNKTVEESTLKYAISVVIYDFLVKTRICEKGSLDTIVLFTDVYTSIMPEELDLHFQRITLELRKLVSIQRSALEPNYDVESRGEELPLSALKFFDTSTIIVKTMAPVHTYIEQKIVAPTPSVEPTDASLKNFKELTCDEDIKILIRVHDTNATKLVIFPSHLKIEIERKKLIIPLKSLYITNTLKYYYSNSYLYVFRFGDPMPFEEELIDHEHVQYKINCYNILRYHLLPDSDVFVYFSNSLNREALEYAFYIFLSKYVNVKQWIDENITRIKELYMINFNN

SEQ ID NO: 551 - protein, 203 aa, synthetic construct
MAWSITNKADTSSFTKMAEIRAHLKNSAENKDKNEDIFPEDVIIPSTKPKTKRATTPRKPAATKRSTKKEEVEEEVVIEEYHQTTEKNSPSPGVSDIVESVAAVELDDSDGDDEPMVQVEAGKVNHSARSDLSDLKVATDNIVKDLKKIITRISAVSTVLEDVQAAGISRQFTSMTKAITTLSDLVTEGKSKVVRKKVKTCKK

SEQ ID NO: 552 - protein, 314 aa, synthetic construct
MRALFYKDGKLFTDNNFLNPVSDDNPAYEVLQHVKIPTHLTDVVVYEQTWEEALTRLIFVGSDSKGRRQYFYGKMHVQNRNAKRDRIFVRVYNVMKRINCFINKNIKKSSTDSNYQLAVFMLMETMFFIRFGKMKYLKENETVGLLTLKNKHIEISPDEIVIKFVGKDKVSHEFVVHKSNRLYKPLLKLTDDSSPEEFLFNKLSERKVYECIKQFGIRIKDLRTYGVNYTFLYNFWTNVKSISPLPSPKKLIALTIKQTAEVVGHTPSISKRAYMATTILEMVKDKNFLDVVSKTTFDEFLSIVVDHVKSSTDG

SEQ ID NO: 553 - protein, 146 aa, synthetic construct
MEMDKRMKSLAMTAFFGELSTLDIMALIMSIFKRHPNNTIFSVDKDGQFMIDFEYDNYKASQYLDLTLTPIFGDECKTHASSIAEQLACADIIKEDISEYIKTTPRLKRFIKKYRNRSDTRISRDTEKLKIALAKGIDYEYIKDAC

SEQ ID NO: 554 - protein, 844 aa, synthetic construct
MDANIVSSSTIATYIDALAKNASELEQRSTAYEINNELELVFIKPPLITLTNVVNISTIQESFIRFTVTNKEGVKIRTKIPLSKVHGLDVKNVQLVDAIDNIVWEKKSLVTENRLHKECLLRLSTEERHIFLDYKKYGSSIRLELVNLIQAKTKNFTIDFKLKYFLGSGAQSKSSLLHAINHPKSRPNTSLEIEFTPRDNEKVPYDELIKELTTLSRHIFMASPENVILSPPINAPIKTFMLPKQDIVGLDLENLYAVTKTDGIPITIRVTSNGLYCYFTHLGYIIRYPVKRIIDSEVVVFGEAVKDKNWTVYLIKLIEPVNAINDRLEESKYVESKLVDICDRIVFKSKKYEGPFTTTSEVVDMLSTYLPKQPEGVILFYSKGPKSNIDFKIKKENTIDQTANVVFRYMSSEPIIFGESSIFVEYKKFSNDKGFPKEYGSGKIVLYNGVNYLNNIYCLEYINTHNEVGIKSVVVPIKFIAEFLVNGEILKPRIDKTMKYINSEDYYGNQHNIIVEHLRDQSIKIGDIFNEDKLSDVGHQYANNDKFRLNPEVSYFTNKRTRGPLGILSNYVKTLLISMYCSKTFLDDSNKRKVLAIDFGNGADLEKYFYGEIALLVATDPDADAIARGNERYNKLNSGIKTKYYKFDYIQETIRSDTFVSSVREVFYFGKFNIIDWQFAIHYSFHPRHYATVMNNLSELTASGGKVLITTMDGDKLSKLTDKKTFIIHKNLPSSENYMSVEKIADDRIVVYNPSTMSTPMTEYIIKKNDIVRVFNEYGFVLVDNVDFATIIERSKKFINGASTMEDRPSTKNFFELNRGAIKCEGLDVEDLLSYYVVYVFSKR

SEQ ID NO: 555 - protein, 146 aa, synthetic construct
MSINIDIKKITDLLNSSILFPDDVQELLREKYIVLERKSNGTPTVAHIYKTMARFDNKSIYRIAKFLFMNRPDVIKLLFLEDVEPLLPDKSINISINNTEYPQLEGPIGTKIALLELFNAFRTGISEPIPYYYLPLRKDINNIVTK

SEQ ID NO: 556 - protein, 237 aa, synthetic construct
MDIFIVKDNKYPKVDNDDNEVFILLGNHNDFIRSKLTKLKEHVFFSEYIVTPDKYGSLCVELNGSSFQHGGRYIEVEEFIDAGRQVRWCSTSNHISEDIPEDIHTDKFVIYDIYTFDAFKNKRLVFVQVPPSLGDDSYLTNPLLSPYYRNSVARQMVNDMIFNQDSFLKYLLEHLIRSHYRVSKHITIVRYKDTEELNLTRICYNRDKFKAFVFAWFNGVSENEKVLDTYKKVSNLI

SEQ ID NO: 557 - protein, 218 aa, synthetic construct
MNSVTVSHAPYTITYHDDWEPVMSQLVEFYNEVASWLLRDETSPIPDKFFIQLKQPLRNKRVCVCGIDPYPKDGTGVPFESPNFTKKSIKEIASSISRLTGVIDYKGYNLNIIDGVIPWNYYLSCKLGETKSHAIYWDKISKLLLQHITKHVSVLYCLGKTDFSNIRAKLESPVTTIVGYHPAARDRQFEKDRSFEIINVLLELDNKAPINWAQGFIY

SEQ ID NO: 558 - protein, 785 aa, synthetic construct
MDAAIRGNDVIFVLKTIGVPSACRQNEDPRFVEAFKCDELERYIENNPECTLFESLRDEEAYSIVRIFMDVDLDACLDEIDYLTAIQDFIIEVSNCVARFAFTECGAIHENVIKSMRSNFSLTKSTNRDKTSFHIIFLDTYTTMDTLIAMKRTLLELSRSSENPLTRSIDTAVYRRKTTLRVVGTRKNPNCDTIHVMQPPHDNIEDYLFTYVDMNNNSYYFSLQQRLEDLVPDKLWEPGFISFEDAIKRVSKIFINSIINFNDLDENNFTTVPLVIDYVTPCALCKKRSHKHPHQLSLENGAIRIYKTGNPHSCKVKIVPLDGNKLFNIAQRILDTNSVLLTERGDHIVWINNSWKFNSEEPLITKLILSIRHQLPKEYSSELLCPRKRKTVEANIRDMLVDSVETDTYPDKLPFKNGVLDLVDGMFYSGDDAKKYTCTVSTGFKFDDTKFVEDSPEMEELMNIINDIQPLTDENKKNRELYEKTLSSCLCGATKGCLTFFFGETATGKSTTKRLLKSAIGDLFVETGQTILTDVLDKGPNPFIANMHLKRSVFCSELPDFACSGSKKIRSDNIKKLTEPCVIGRPCFSNKINNRNHATIIIDTNYKPVFDRIDNALMRRIAVVRFRTHFSQPSGREAAENNDAYDKVKLLDEGLDGKIQNNRYRFAFLYLLVKWYRKYHVPIMKLYPTPEEIPDFAFYLKIGTLLVSSSVKHIPLMTDLSKKGYILYDNVVTLPLTTFQQKISKYFNSRLFGHDIESFINRHKKFANVSDEYLQYIFIEDISSP

SEQ ID NO: 559 - protein, 637 aa, synthetic construct
MNTGIIDLFDNHVDSIPTILPHQLATLDYLVRTIIDENRSVLLFHIMGSGKTIIALLFALVASRFKKVYILVPNINILKIFNYNMGVAMNLFNDEFIAENIFIHSTTSFYSLNYNDNVINYNGLSRYNNSIFIVDEAHNIFGNNTGELMTVIKNKNKIPFLLLSGSPITNTPNTLGHIIDLMSEETIDFGEIISRGKKVIQTLLNERGVNVLKDLLKGRISYYEMPDKDLPTIRYHGRKFLDTRVVYCHMSKLQERDYMITRRQLCYHEMFDKNMYNVSMAVLGQLNLMNNLDTLFQEQDKELYPNLKINNGVLYGEELVTLNISSKFKYFINRIQTLNGKHFIYFSNSTYGGLVIKYIMLSNGYSEYNGSQGTNPHMINGKPKTFAIVTSKMKSSLEDLLDVYNSPENDDGSQLMFLFSSNIMSESYTLKEVRHIWFMTIPDTFSQYNQILGRSIRKFSYADISEPVNVYLLAAVYSDFNDEVTSLNDYTQDELINVLPFDIKKLLYLKFKTKETNRIYSILQEMSETYSLPPHPSIVKVLLGELVRQFFYNNSRIKYNDSKLLKMVTSVIKNKEDARNYIDDIVNGHFFVSNKVFDKSLLYKYENDIITVPFRLSYEPFVWGVNFRKEYNVVSSP

SEQ ID NO: 560 - protein, 161 aa, synthetic construct
MSSFVTNGYLPVTLEPHELTLDIKTNIRNAVYKTYLHREISGKMAKKIEIREDVELPLGEIVNNSVVINVPCVITYAYYHVGDIVRGTLNIEDESNVTIQCGDLICKLSRDSGTVSFSDSKYCFFRNGNAYDNGSEVTAVLMEAQQGIESSFVFLANIVDS

SEQ ID NO: 561 - protein, 304 aa, synthetic construct
MPQQLSPINIETKKAISNARLKPLDIHYNESKPTTIQNTGKLVRINFKGGYISGGFLPNEYVLSSLHIYWGKEDDYGSNHLIDVYKYSGEINLVHWNKKKYSSYEEAKKHDDGLIIISIFLQVLDHKNVYFQKIVNQLDSIRSANTSAPFDSVFYLDNLLPSKLDYFTYLGTTINHSADAVWIIFPTPINIHSDQLSKFRTLLSSSNHDGKPHYITENYRNPYKLNDDTQVYYSGEIIRAATTSPARENYFMRWLSDLRETCFSYYQKYIEENKTFAIIAIVFVFILTAILFFMSRRYSREKQN

SEQ ID NO: 562 - protein, 213 aa, synthetic construct
MGITMDEEVIFETPRELISIKRIKDIPRSKDTHVFAACITSDGYPLIGARRTSFAFQAILSQQNSDSIFRVSTKLLRFMYYNELREIFRRLRKGSINNIDPHFEELILLGGKLDKKESIKDCLRRELKEESDERITVKEFGNVILKLTTRDKLFNKVYISYCMACFINQSLEDLSHTSIYNVEIRKIKSLNDCINDDKYEYLSYIYNMLVNSK

SEQ ID NO: 563 - protein, 248 aa, synthetic construct
MNFYRSSIISQIIKYNRRLAKSIICEDDSQIITLTAFVNQCLWCHKRVSVSAILLTTDNKILVCNRRDSFLYSEIIRTRNMSRKKRLFLNYSNYLSKQERSILSSFFSLDPATTDNDRIDAIYPGGIPKRGENVPECLSREIKEEVNIDNSFVFIDTRFFIHGIIEDTIINKFFEVIFFVGRISLTSDQIIDTFKSNHEIKDLIFLDPNSGNGLQYEIAKYALDTAKLKCYGHRGCYYESLKKLTEDD

SEQ ID NO: 564 - protein, 631 aa, synthetic construct
MSKSHAAYIDYALRRTTNMPVEMMGSDVVRLKDYQHFVARVFLGLDSMHSLLLFHETGVGKTMTTVYILKHLKDIYTNWAIILLVKKALIEDPWMNTILRYAPEITKDCIFINYDDQNFRNKFFTNIKTINSKSRICVIIDECHNFISKSLIKEDGKIRPTRSVYNFLSKTIALKNHKMICLSATPIVNSVQEFTMLVNLLRPGSLQHQSLFENKRLVDEKELVSKLGGLCSYIVNNEFSIFDDVEGSASFAKKTVLMRYVNMSKKQEEIYQKAKLAEIKTGISSFRILRRMATTFTFDSFPERQNRDPGEYAQEIATLYNDFKNSLRDREFSKSALDTFKKGELLKGDASAADISLFTELKEKSVKFIDVCLGILASHGKCLVFEPFVNQSGIEILLLYFKVFGISNIEFSSRTKDTRIKAVAEFNQESNTNGECIKTCVFSSSGGEGISFFSINDIFILDMTWNEASLRQIVGRAIRLNSHVLTPPERRYVNVHFIMARLSNGMPTVDEDLFEIIQSKSKEFVQLFRVFKHTSLEWIHANEKDFSPIDNESGWKTLVSRAIDLSSKKNITNKLIEGTNIWYSNSNRLMSINRGFKGVDGRVYDVDGNYLHDMPDNPVIKIHDGKLIYIF

SEQ ID NO: 565 - protein, 287 aa, synthetic construct
MDEIVKNIREGTHVLLPFYETLPELNLSLGKSPLPSLEYGANYFLQISRVNDLNRMPTDMLKLFTHDIMLPESDLDKVYEILKINSVKYYGRSTKADAVVADLSARNKLFKRERDAIKSNNHLTENNLYISDYKMLTFDVFRPLFDFVNEKYCIIKLPTLFGRGVIDTMRIYCSLFKNVRLLKCVSDSWLKDSAIMVASDVCKKNLDLFMSHVKSVTKSSSWKDVNSVQFSILNNPVDTEFINKFLEFSNRVYEALYYVHSLLYSSMTSDSKSIENKHQRRLVKLLL

SEQ ID NO: 566 - protein, 551 aa, synthetic construct
MNNTIINSLIGGDDSIKRSNVFAVDSQIPTLYMPQYISLSGVMTNDGPDNQAIASFEIRDQYITALNHLVLSLELPEVKGMGRFGYVPYVGYKCINHVSISSCNGVIWEIEGEELYNNCINNTIALKHSGYSSELNDISIGLTPNDTIKEPSTVYVYIKTPFDVEDTFSSLKLSDSKITVTVTFNPVSDIVIRDSSFDFETFNKEFVYVPELSFIGYMVKNVQIKPSFIEKPRRVIGQINQPTATVTEVHAATSLSVYTKPYYGNTDNKFISYPGYSQDEKDYIDAYVSRLLDDLVIVSDGPPTGYPESAEIVEVPEDGIVSIQDADVYVKIDNVPDNMSVYLHTNLLMFGTRKNSFIYNISKKFSAITGTYSDATKRTIFAHISHSINIIDTSIPVSLWTSQRNVYNGDNRSAESKAKDLFINDPFIKGIDFKNKTDIISRLEVRFGNDVLYSENGPISRIYNELLTKSNNGTRTLTFNFTPKIFFRPTTITANVSRGKDKLSVRVVYSTMDVNHPIYYVQKQLVVVCNDLYKVSYDQGVSITKIMGDNN

SEQ ID NO: 567 - protein, 150 aa, synthetic construct
MAKRVSLPDVVISAPKAVFKPAKEEALACILPKYYKSMADVSIKTNSVIDKCWFCNQDLVFKPISIETFKGGEVGYFCSKICRDSLASMVKSHVALREEPKISLLPLVFYEDKEKVINTINLLRDKDGVYGSCYFKENSQIIDISLRSLL

SEQ ID NO: 568 - protein, 224 aa, synthetic construct
MNLRLCSGCRHNGIVSEQGYEYCIFCESVFQKCTKVQKKSNFHVSNKLIHLRNVLRRLLSHQCSGEIISELLDIMEKNQISTDDVDANFVSSFLKANERINKKDYKLVFEIINQVKDEKLNLSTEKINEVVEIFKHLVFFCQENTPSKTINYSFFLDKIFDITSVTKNLKPQTVKNYTKNNSNQLVWENFLAHMRSKKRVTMVEDYGHEYVFVDERFSTCSLEV

SEQ ID NO: 569 - protein, 76 aa, synthetic construct
MSWYEKYNIVLNPPKRCSFACADNLTTILAEDGNNIRAILYSQPKKLKILQDFLATSRNKMFLYKILDDEIRRVLT

SEQ ID NO: 570 - protein, 644 aa, synthetic construct
MEAVVNSDVFLTSNAGLKSSYTNQTLSLVDEDHIHTSDKSLSCSVCNSLSKIVDDDFISAGARNQRTKPKRAGNNQSQQPIKKDCMVSIDEVASTHDWSTRLRNDGNAIAKYLTTNKYDTSNFTIQDMLNIMNKLNIVRTNRNELFQLLTHVKSTLNNASVSVKCTHPLVLIHSRASPRIGDQLKELDKIYSPSNHHILLSTTRFQSMHFTDMSSSQDLSFIYRKPETNYYIHPILMALFGIKLPALENAYVHGDTYSLIQQLYEFRKVKSYNYMLLVNRLTEDNPIVITGVSDLISTEIQRANMHTMIRKAIMNIRMGIFYCNDDDAVDPHLMKIIHTGCSQVMTDEEQILASILSIVGFRPTLVSVARPINGISYDMKLQAAPYIVVNPMKMITTSDSPISINSKDIYSMAFDGNSGRVVFAPPNIGYGRCSGVTHIDPLGTNVMGSAVHSPVIVNGAMMFYVERRQNKNMFGGECYTGFRSLIDDTPIDVSPEIMLNGIMYRLKSAVCYKLGDQFFDCGSSDIFLKGHYTILFTENGPWMYDPLSVFNPGARNARLMRALKNQYKKLSMDSDDGFYEWLNGDGSVFAASKQQMLMNHVANFDDDLLTMEEAMSMISRHCCILIYAQDYDQYISARHITELF

SEQ ID NO: 571 - protein, 283 aa, synthetic construct
MDFFNKFSQGLAESSTPKSSIYYSEKKDPDTKKDEAIEIGLKSQESYYQRQLREQLARDNMMAASRQPIQPLQPTIHITPQPVPVPTPTSAPILLPSSTAPTPKPRQQTNTSSDMSNLFDWLSADTDAPASSLLPALTPSNAVQDIISKFNKDQKTTTPPSTQPSQTLPTTTCTQQSDGSISCTTPTVTPPQPPIVATVCTPTPTGGTVCTTAQQNPNPGAASQQNLDDMALKDLMSSVEKDMHQLQAETNDLVTNVYDAREYTRRAIDQILQLVKGFERFQK

SEQ ID NO: 572 - protein, 164 aa, synthetic construct
MADTDDIIDYESDDLTEYEDDEEEEEDGESLETSDIDPKSSYKIVESASTHIEDAHSNLKHIGNHISALKRRYTRRISLFEIAGIIAESYNLLQRGRLPLVSEFSDETMKQNMLHVIIQEIEEGSCPIVIEKNGELLSVNDFDKDGLKFHLDYIIKIWKLQKRY

SEQ ID NO: 573 - protein, 372 aa, synthetic construct
MDKLRVLYDEFVTISKDNLERETGLSASDVDMDFDLNIFMTLVPVLEKKVCAITPTIEDDKIVTMMKYCSYQSFSFWFLKSGAVVKSVYNKLDDVKKEKFVATFRDMLLNVQTLISLNSMYTRLRQDTEDIVSDSKKIMEIVSHLRASTTENAAYQVLQQNNSFIISTLNKILSDENYLLKIIAVFDSKLISEKETLNEYKQLYTISSESLVYGIRCVSNLDISSVQLSNNKYVLFVKKMLPKIILFQNNDINAQQFANVISKIYTLIYRQLTSNVDVGCLLTDTIESAKTKISVEKIKQTGINNVQSLIKFISDNKKEYKTIISEEYLSKEDRIITILQDIVNEHDIKYDNKLLNMRDLIVTFRERYSYKF

SEQ ID NO: 574 - protein, 710 aa, synthetic construct
MRYIVSPQLVLQVGKGQEVERALYLTPYDYIDEKSPIYYFLRSHLNIQQPEIVKRHILLTLRMTQLKGYLGNLLDIKDDIIIYSHKNNLEYSYVDNTIFNPFVYTQKKTLLKNDSFLYNVYPGACDFLVIWVARACDTSIPEFGSYEDVDNNIIKFETMLMEVFPQLDLDITIESKFNNIFRTNLKLTGLKKIIQRVQDLDINYKSLLSRYDEHFINMTGNHFILNDEQLNLSIWDLDGTLALSSDGDTVMINNVKLFTDLVSDIDTQMERIKGDITYKVHLATPINSRIKLDIETSFIFIETATNNILLSSDKKISIILAKNHISIKVKNHIPNIEKYFTFLVIAINAMFNSVQKSADFTKVETVYWSRICQNTKNKNRKPIIINYLDPGMKKISNNFYRSDEKEVFINDNGIMFTCMDPLGKYNKVGFLNIFHDMRKYCIPCCFLHDQSHRSTFSSCVHQIDVEKKIVSPYILNFGKVVTESKMSFLPIIFDAFLNDGMTANMEQDNKRLKETSGYHIVRCCAGDDIVRLRTTSDIIQFVNEDKNILIVNDMVYFPMNASDIGKKIHILIQEIVHEVMIVKKKESSDKIDFFPPNYKLLKDLFPKQTIQTPIQSDAGMVLTTDGFYIDGKLFNEDLSSKYVTFTKNVIASDAVAKYFSPLFKYVISEAKDRFIKTWMINIMIHMNVDPNNIIPTLEKYYPNSGRAQIN

SEQ ID NO: 575 - protein, 288 aa, synthetic construct
MFEPVPDLNLEASVELGEVNIDQTTPMIKENSGFISRSRRLFAHRSKDDERKLALRFFLQRLYFLDHREIHYLFRCVDAVKDVTITKKNNIIVAPYIALLTIASKGCKLTETMIEAFFPELYNEHSKKFKFNSQVSIIQEKLGYQFGNYHVYDFEPYYSTVALAIRDEHSSGIFNIRQESYLVSSLSEITYRFYLINLKSDLVQWSASTGAVINQMVNTVLITVYEKLQLVIENDSQFTCSLAVESKLPIKLLKDRNELFTKFINELKKTSSFKISKRDKDTLLKYFT

SEQ ID NO: 576 - protein, 99 aa, synthetic construct
MSCYTAILKSVGGLALFQVANGAIDLCRHFFMYFCEQKLRPNSFWFVVVRAIASMIMYLVLGIALLYISEQDNKKNTNNDGSNNDKRNESSINSNSSPK

SEQ ID NO: 577 - protein, 891 aa, synthetic construct
MMPIKSIVTLDQLEDSEYLFRIVSTVLPHLCLDYKVCDKLKTTFVHPFDILLNNSLGSVTKQDELQAAISKLGINYLIDTTSRELKLFNVTLNAGNIDIINTPINISSETNPIINTHSFYDLPPFTQHLLNIRLTDTEYRARFIGGYIKPDGSDSMDVLAEKKYPDLNFDNTYLFNILYKDVINAPIKEFKAKIVNGVLSRQDFDNLIGVRQYITIQDRPRFDDAYNIADAARHYGVNLNTLPLPNVDLTTMPTYKHLIMFEQYFIYTYDRVDIYYNGNKMLFDDEIINFTISMRYQSLIPRLVDFFPDIPVNNNIVLHTRDPQNAAVNVTVALPNVQFVDINRNNKFFINFFNLLAKEQRSTAIKVTKSMFWDGMDYEEYKSKNLQDMMFINSTCYVFGLYNHNNTTYCSILSDIISAEKTPIRVCLLPRVVGGKTVTNLISETLKSISSMTIREFPRKDKSIMHIGLSETGFMRFFQLLRLMADKPHETAIKEVVMAYVGIKLGDKGSPYYIRKESYQDFIYLLFASMGFKVTTRRSIMGSNNISIISIRPKVTKQYIVTTLMKTSCSKNEAEKLITSAFDLLNFMVSVSDFRDYQSYRQYRNYCPRYFYAGSPEGEETIICDSEPISILDRIDTRGIFSAYTINEMMDTDIFSPENKAFKNNLSRFIESGDITGEDIFCAMPYNILDRIITNAGTCTVSIGDMLDNITTQSDCNMTNEITDMINASLKNTISKDNNMLVSQALDSVANRSKQTIGDLRQSSCKMALLFKNLVTSIYTIERIFNAKVGDDVKASMLEKYKVFTDISMSLYKDLIAMENLKAMLYIIRRSGCRIDDAQITTDDLVKSYSLIRPKILSMINYYNEMSRGYFEHMKKNLNMTDGDSVSFDDE

SEQ ID NO: 578 - protein, 318 aa, synthetic construct
MTTVPVTDIQNDLITEFSEDNYPSNKNYEITLRQMSILTHVNNVVDREHNAAVVSSPEEISSQLNEDLFPDDDSPATIIERVQPHTTIIDDTPPPTFRRELLISEQRQQREKRFNITVSKNAEAIMESRSMITSMPTQTPSLGVVYDKDKRIQMLEDEVVNLRNQRSNTKSSDNLDNFTKILFGKTPYKSTEVNKRIAIVNYANLNGSPLSVEDLDVCSEDEIDRIYKTIKQYHESRKRKIIVTNVIIIVINIIEQALLKLGFEEIKGLSTDITSEIIDVEIGDDCDAVASKLGIGNSPVLNIVLFILKIFVKRIKII

SEQ ID NO: 579 - protein, 192 aa, synthetic construct
MADKKNLAVRSSYDDYIETVNKITPQLKNLLAQIGGDAAVKGGNNNLNSQTDVTAGACDTKSKSSKCITCKPKSKSSSSSTSASKGSKNTSGAPKRRTTVTTTSYNAMDGQIVQAVTNAGKIVYGTVRDGQLEVRGMVGEINHDLLGIDSVNAGKKKPSKKMPTNKKINMSSGMRRQEQINPDDCCLDMGMY

SEQ ID NO: 580 - protein, 70 aa, synthetic construct
MIGILLLIGICVAVTVAILYSMYNKIKNLQNLNPSPNLNSPPPEPKNTKFVNNLEKDHISSLYNLVKSSA

SEQ ID NO: 581 - protein, 90 aa, synthetic construct [sequence omitted]

SEQ ID NO: 582 - protein, 53 aa, synthetic construct
MISNYEPLLLLVITCCVLLFNFTISSKTKIDIIFAVQTIVFIWFIFHFVHSAI

SEQ ID NO: 583 - protein, 94 aa, synthetic construct
MFVDDNSLIIYSTWPSTLSDSSGRVIVMPDNRSFTFKEGFKLDESIKSILLVNPSSIDLLKIRVYKHRIKWMGDIFVLFEQENIPPPFRLVNDK

SEQ ID NO: 584 - protein, 377 aa, synthetic construct
MGAAVTLNRIKIAPGIADIRDKYMELGFNYPEYNRAVKFAEESYTYYYETSPGEIKPKFCLIDGMSIDHCSSFIVPEFAKQYVLIHGEPCSSFKFRPGSLIYYQNEVTPEYIKDLKHATDYIASGQRCHFIKKDYLLGDSDSVAKCCSKTNTKHCPKIFNNNYKTEHCDDFMTGFCRNDPGNPNCLEWLRAKRKPAMSTYSDICSKHMDARYCSEFIRIIRPDYFTFGDTALYVFCNDHKGNRNCWCANYPKSNSGDKYLGPRVCWLHECTDESRDRKWLYYNQDVQRTRCKYVGCTINVNSLALKNSQAELTSNCTRTTSAVGDVHPGEPVVKDKIKLPTWLGAAITLVVISVIFYFISIYSRPKIKTNDINVRRR

SEQ ID NO: 585 - protein, 203 aa, synthetic construct
MSYLRYYNMLDDFSAGAGVLDKDLFTEEQQQSFMPKDGGMMQNDYGGMNDYLGIFKNNDVRTLLGLILFVLALYSPPLISILMIFISSFLLPLTSLVITYCLVTQMYRGGNGNTVGMSIVCIVAAVIIMAINVFTNSQIFNIISYIILFILFFAYVMNIERQDYRRSINVTIPEQYTCNKPYTAGNKVDVDIPTFNSLNTDDY

SEQ ID NO: 586 - protein, 493 aa, synthetic construct
MSLLKMEYNLYAELKKMTCGQPLSLFNEDGDFVEVEPGSSFKFLIPKGFYASPSVKTSLVFETLTTTDNKITSINPTNAPKLYPLQRKVVSEVVSNMRKMIESKRPLYITLHLACGFGKTITTCYLMATHGRKTVICVPNKMLIHQWKTQVEAVGLEHKISIDGVSSLLKELKTQSPDVLIVVSRHLTNDAFCKYINKHYDLFILDESHTYNLMNNTAVTRFLAYYPPMMCYFLTATPRPSNRIYCNSIINIAKLSDLKKTIYAVDSFFEPYSTDNIRHMIKRLDGPSNKYHIYTEKLLSVDEPRNQLILDTLVEEFKSGTINRILVITKLREHMVFFYKRLLDLFGPEVVFIGDAQNRRTPDMVKSIKELNRFIFVSTLFYSGTGLDIPSLDSLFICSAVINNMQIEQLLGRVCRETELLDRTVYVFPNTSIKEIKYMIGNFMQRIISLSVDKLGFKQKSYRKHQESDPTSVCTTSSREERVLNRIFNSQNR

SEQ ID NO: 587 - protein, 77 aa, synthetic construct
MDSTNVRSGMKSRKKKPKTTVIDDDDDCMTCSACQSKLVKISDITKVSLDYINTMRGNTLACAACGSSLKLLNDFAS

SEQ ID NO: 588 - protein, 117 aa, synthetic construct
MITLFLILCYFILIFNIIVPAISEKMRRERAAYVNYKRLNKNFICVDDRLFSYNFTTSGIKAKMAVDNKNVPIPCSKINEVNNNKDVDTLYCDKDRDDIPGFARSCYRAYSDLFFTT

SEQ ID NO: 589 - protein, 426 aa, synthetic construct
MTSSADLTNLKELLSLYKSLRFSDSAAIEKYNSLVEWGTSTYWKIGVQKVANVETSISDYYDEVKNKPFNIDPGYYIFLPVYFGSVFIYSKGKNMVELGSGNSFQIPDDMRSACNKVLDSDNGIDFLRFVLLNNRWIMEDAISKYQSPVNIFKLASEYGLNIPKYLEIEIEEDTLFDDELYSIIERSFDDKFPKISISYIKLGELRRQVVDFFKFSFMYIESIKVDRIGDNIFIPSVITKSGKKILVKDVDHLIRSKVREHTFVKVKKKNTFSILYDYDGNGTETRGEVIKRIIDTIGRDYYVNGKYFSKVGSAGLKQLTNKLDINECATVDELVDEINKSGTVKRKIKNQSAFDLSRECLGYPEADFITLVNNMRFKIENCKVVNFNIENTNCLNNPSIETIYGNFNQFVSIFNIVTDVKKRLFE

SEQ ID NO: 590 - protein, 187 aa, synthetic construct
METLTSSSQSLISSPMSKKDYSSEIICAFDIGAKNPARTVLEVKDNSVRVLDISKLDWSSDWERRIAKDLSQYEYTTVLLERQPRRSPYVKFIYFIKGFLYHTSAAKVICVSPVMSGNSYRDRKKRSVEAFLDWMDTFGLRDSVPDRRKLDDVADSFNLAMRYVLDKWNTNYTPYNRCKSRNYIKKM

SEQ ID NO: 591 - protein, 382 aa, synthetic construct
MDNLFTFLHEIEDRYARTIFNFHLISCDEIGDIYGLMKERISSEDMFDNIVYNKDIHPAIKKLVYCDIQLTKHIINQNTYPVFNDSSQVKCCHYFDINSDNSNISSRTVEIFEREKSSLVSYIKTTNKKRKVNYGEIKKTVHGGTNANYFSGKKSDEYLSTTVRSNINQPWIKTISKRMRVDIINHSIVTRGKSSILQTIEIIFTNRTCVKIFKDSTMHIILSKDKDEKGCIHMIDKLFYVYYNLFLLFEDIIQNEYFKEVANVVNHVLTATALDEKLFLIKKMAEHDVYGVSNFKIGMFNLTFIKSLDHTVFPSLLDEDSKIKFFKGKKLNIVALRSLEDCINYVTKSENMIEMMKERSTILNSIDIETESVDRLKELLLK

SEQ ID NO: 592 - protein, 1164 aa, synthetic construct
MKKNTDSEMDQRLGYKFLVPDPKAGVFYRPLHFQYVSYSNFILHRLHEILTVKRPLLSFKNNTERIMIEISNVKVTPPDYSPIIASIKGKSYDALATFTVNIFKEVMTKEGISITKISSYEGKDSHLIKIPLLIGYGNKNPLDTAKYLVPNVIGGVFINKQSVEKVGINLVEKITTWPKFRVVKPNSFTFSFSSVSPPNVLPTRYRHYKISLDISQLEALNISSTKTFITVNIVLLSQYLSRVSLEFIRRSLSYDMPPEVVYLVNAIIDSAKRITESITDFNIDTYINDLVEAEHIKQKSQLTINEFKYEMLHNFLPHMNYTPDQLKGFYMISLLRKFLYCIFHTSRYPDRDSMVCHRILTYGKYFETLAHDELENYIGNIRNDIMNNHKNRGTYAVNIHVLTTPGLNHAFSSLLSGKFKKSDGSYRTHPHYSWMQNISIPRSVGFYPDQVKISKMFSVRKYHPSQYLYFCSSDVPERGPQVGLVSQLSVLSSITNILTSEYLDLEKKICEYIRSYYKDDISYFETGFPITIENALVASLNPNMICDFVTDFRRRKRMGFFGNLEVGITLVRDHMNEIRINIGAGRLVRPFLVVDNGELMMDVCPELESRLDDMTFSDIQKEFPHVIEMVDIEQFTFSNVCESVQKFRMMSKDERKQYDLCDFPAEFRDGYVASSLVGINHNSGPRAILGCAQAKQAISCLSSDIRNKIDNGIHLMYPERPIVISKALETSKIAANCFGQHVTIALMSYKGINQEDGIIIKKQFIQRGGLDIVTAKKHQVEIPLENFNNKERDRSNAYSKLESNGLVRLNAFLESGDAMARNISSRTLEDDFARDNQISFDVSEKYTDMYKSRVERVQVELTDKVKVRVLTMKERRPILGDKFTTRTSQKGTVAYVADETELPYDENGITPDVIINSTSIFSRKTISMLIEVILTAAYSAKPYNNKGENRPVCFPSSNETSIDTYMQFAKQCYEHSNPKLSDEELSDKIFCEKILYDPETDKPYASKVFFGPIYYLRLRHLTQDKATVRCRGKKTKLIRQANEGRKRGGGIKFGEMERDCLIAHGAANTITEVLKDSEEDYQDVYVCENCGDIAAQIKGINTCLRCSKLNLSPLLTKIDTTHVSKVFLTQMNARGVKVKLDFERRPPSFYKPLDKVDLKPSFLV

SEQ ID NO: 593 - protein, 209 aa, synthetic construct
METIKALEKFMEFDRLQKDCSDKLDRERERRMKAEREIARKNCGGNPCERELESERSNVKRLEYQLDAEKEKVKFYKRELERDRYLSSRYLTSSSDPHEKPLPNYTFSRIKNVSPLTTEATGSVEVAPPSTDVTEPISDVTPSVDAEPEHPQLSEYQTSVSQVAVTPPPKPETPQIFEYQTSDSIVNNPRPFYNSDLEFDDIDMYLLPN

SEQ ID NO: 594 - protein, 227 aa, synthetic construct
MKPMLKQREMRRLRDRISDIERQLSDCRRNNESNADMEREMQRLRDRIMDLDRQLNECKRNGNGTSSEEVNRLKTRIRNLKRSLEICSKDESELYSAYKTKLGRAREQISNLQESLRRERESDKTDSYYRRELTRERNKIVELEKELNKCFDAKYIDEINSKKTRISDLERQLAACKSNGGSNGNMDQYKREIESLKRELAECRRGNNGSHSDCAYYDEEAREEVKS

SEQ ID NO: 595 - protein, 725 aa, synthetic construct
MEVTNLIEKCTKHSKDFATEVEKLWNDELSSESGLSRKTRNVIRNILRDITKSLTTDKKSKCFRILERSTINGEQIKDVYKTIFNNGVDVESRINTTGKYVLFTVMTYVAAELRLIKSDEIFALLLRFFNMICDIHRKYGCGNMFVGIPAALINLLEIDHINKLFSVFSTRYDAKTYLYTEYFLFLNINHYLLSGSDLFINVAYGAVSFSSPISVPDYIMEALTFKACDHIMKSGDLKYTYAFTKKVKDLFNTKSDSIYQYVRLHEMSYDGVSEDTDDDDEVFAILNLSIDSSVDRYRNRVLLLTPEVASLRKEYSEVEPDYKYLMDEEVPAYDKHLPKPITNTGIEEPHATGGDEDQPIKVVHPPNNDKDDAIKPYNPLEDPNYVPTITRTAIGIADYQLVINKLIEWLDKCEEECGNSGEFKTELEEAKRKLTELNAELSDKLSKIRTLERDSVYKTERIDRLTKEIKEHRDIQNGTDDGSDLLEIDKKTIRELRESLDREREMRSELEKELDTIRNGKVDGSCQRELELSRMWLKQRDDDLRAEIDKRRNVEWELSRLRRDIKECDKYKEDLDKAKTTISNYVSKISTLESEIAKYQQDRDTLSVVRRELEEERRRVRDLESRLDECTRNQEDTQEVDALRSRIRELENKLTNCIESGGGNLTEISRLQSKISDLERQLSECRENATEISRLQSRISDLERQLNDCRRNNETNAETERDATS

SEQ ID NO: 596 - protein, 502 aa, synthetic construct
MANIINLWNGIVPTVQDVNVASITAFKSMIDETWDKKIEANTCISRKHRNIIHEVIRDFMKAYPKMDENKKSPLGAPMQWLTQYYILKNEYHKTMLAYDNGSLNTKFKTLNIYMITNVGQYILYIVFCIISGKNHDGTPYIYDSEITSNDKNFINERIKYACKQILHGQLTIALRIRNKFMFIGSPMYLWFNVNGSQVYHDIYDRNAGFHNKEIGRLLYAFMYYLSISGRFLNDFALLKFTYLGESWTFSLSVPEYILYGLGYSVFDTIEKFSNDAILVYIRTNNRNGYDYVEFNKKGIAKVTEDKPDNDKRIHAIRLINDSTDVQHIHFGFRNMVIIDNECANIQSSAENATDTGHHQDSKINIEVEDDDDVIDDDDYNPKPTPIPEPHPRPPFPRHEYHKRPKLLPVEEPDPVKKDADRIRLDNHILNTLDHNLNFIGHYCCDTAAVDRLEHHIETLGQYAVILARKINMQSLLFPWPLPTVHPHAIDGSIPPHGRFTIL

SEQ ID NO: 597 - protein, 110 aa, synthetic construct
MDGTLFPGDDDLAIPATEFFSTKAAKKPEAKREAIVKADEDDNEETLKQRLTNLEKKITNVTTKFEQIEKCCKRNDEVLFRLENHAETLRAAMISLAKKIDVQTGRRPYE

SEQ ID NO: 598 - protein, 146 aa, synthetic construct
MNSLSIFFIVVATAAVCLLFIQGYSIYENYGNIKEFNATHAAFEYSKSIGGTPALDRRVQDVNDTISDVKQKWRCVVYPGNGFVSASIFGFQAEVGPNNTRSIRKFNTMQQCIDFTFSDVINIDIYNPCVVPNINNAECQFLKSVL

SEQ ID NO: 599 - protein, 305 aa, synthetic construct
MQHPREENSIVVELEPSLATFIKQGFNNLVKWPLLNIGIVLSNTSTAVNEEWLTAVEHIPTMKIFYKHIHKILTREMGFLVYLKRSQSERDNYITLYDFDYYIIDKDTNSVTMVDKPTELKETLLHVFQEYRLKSSQTIELIAFSSGTVINEDIVSKLTFLDVEVFNREYNNVKTIIDPDFVFRSPFIVISPMGKLTFFVEVYSWFDFKSCFKDIIDFLEGALIANIHNHMIKVGNCDETVSSYNPESGMLFVNDLMTMNIVNFFGCNSRLESYHRFDMTKVDVELFIKALSDACKKILSASNRL

SEQ ID NO: 600 - protein, 77 aa, synthetic construct
MEDLNEANFSHLLINLSNNKDIDAQYASTLSVVHELLSAINFKIFNINKKSKKNSKSIEQHPVVHHAASAGREFNRR

SEQ ID NO: 601 - protein, 124 aa, synthetic construct
MASILNTLRFLEKTSFYNCNDSITKEKIKIKHKGMSFVFYKPKHSTVVKYLSGGGIYHDDLVVLGKVTINDLKMMLFYMDLSYHGVTSSGAIYKLGSSIDRLSLNRTIVTKVNNYDDTFFDDDD

SEQ ID NO: 602 - protein, 270 aa, synthetic construct
MNCFQEKQFSRENLLKMPFRMVLTGGSGSGKTIYLLSLFSTLVKKYKHIFLFTPVYNPDYDGYIWPNHINFVSSQESLEYNLIRTKSNIEKCIAVAQNHKKSAHFLLIFDDVGDKLSKCNTLIEFLNFGRHLNTSIILLCQTYRHVPILGRANITHFCSFNISISDAENMLRSMPVKGKRKDILNMLNMIQTARSNNRLAIIIEDSVFCEGELRICTDTADKDVIEQKLNIDILVNQYSHMKKNLNAILESKKTKLCNSDQSSSSKNVSS

SEQ ID NO: 603 - protein, 185 aa, synthetic construct
MMTPENDEEQTSVFSATVYRDKIQGKNKRKRVIGLCIRISMVISLLSMITMSAFLIVRLNQCMSANEAAITDAAVAVAAASSTHRKVASSTTQYDHKESCNGLYYQGSCYILHSDYQLFSDAKANCTAESSTLPNKSDVLTTWLIDYVKDTWGSDGNPITKTTSDYQDSDVSQEVRKYFCVKTMN

SEQ ID NO: 604 - protein, 168 aa, synthetic construct
MKSLNRQTVSRFKKLSVPAAIMMILSTIISGIGTFLHYKEELMPSACANGWIQYDKHCYLDTNIKMSTDNAVYQCRKLRARLPRPDTRHLRVLFSIFYKDYWVSLKKTNDKWLDINNDKDIDISKLTNFKQLNSTTDAEACYIYKSGKLVKTVCKSTQSVLCVKKFYK

SEQ ID NO: 605 - protein, 176 aa, synthetic construct
MDAAFVITPMGVLTITDTLYDDLDISIMDFIGPYIIGNIKTVQIDVRDIKYSDMQKCYFSYKGKIVPQDSNDLARFNIYSICAAYRSKNTIIIACDYDIMLDIEDKHQPFYLFPSIDVFNATIIEAYNLYTAGDYHLIINPSDNLKMKLSFNSSFCISDGNGWIIIDGKCNSNFLS

SEQ ID NO: 606 - protein, 208 aa, synthetic construct
MMLVPLITVTVVAGTILVCYILYICRKKIRTVYNDNKIIMTKLKKIKSSNSSKSSKSTDSESDWEDHCSAMEQNNDVDNISRNEILDDDSFAGSLIWDNESNVMAPSTEHIYDSVAGSTLLINNDRNEQTIYQNTTVVLNEDTKQNPNYSSNPFVNYNKTSICSKSNPFITELNNKFSENNPFRRAHSDDYLNKQEQDHEHDDIESLV

SEQ ID NO: 607 - protein, 263 aa, synthetic construct
MEIFPVFGISKISNFIANNDCRYYIDTEHQKIISDEINRQMDETVLLTNILSVEVVNDNEMYHLIPHRLSTIILCISSVGGCVISIDNDVNGKNILTFPIDHAVIISPLSKCVVVSKGPTTILVVKADIPSKRLVTSFTNDILYVNNLSLINYLPLSVFIIRRVTDYLDRHICDQIFANNKWYSIITIDNKQFPIPSNCIGMSSAKYINSSIEQDTLIHVCNLEHPFDLVYKKMQSYNSVPIKEQILYGRIDNINMSISISVD

SEQ ID NO: 608 - protein, 57 aa, synthetic construct
MDSFSSLFMKLCCISTDKTGSKKSDKKNKNKIKDYYKITIVPGSSSTSTSSWYYTHA

SEQ ID NO: 609 - protein, 277 aa, synthetic construct
MSRVRISLIYLYTLVVITTTKTIEYTACNDTIIIPCTIDNPTKYIRWKLDNHDILTYNKTSKTTILSKWHTSARLHSLSDSDVSLIMEYKDILPGTYTCGDNTGIKSTVKLVQLHTNWFNDYQTMLMFIFTGITLFLLFLEITYTSISVVFSTNLGILQVFGCVIAMIELCGAFLFYPSMFTLRHIIGLLMMTLPSIFLIITKVFSFWLLCKLSCAVHLIIYYQLAGYILTVLGLGLSLKECVDGTLLLSGLGTIMVSEHFSLLFLVCFPSTQRDYY

SEQ ID NO: 610 - protein, 83 aa, synthetic construct
MIPLLFILFYFANGIEWHKFETSEEIISTYLLDDVLYTGVNGAVYTFSNNKLNKTGLTNNNYITTSIKVEDAEPITEIPNVGK

SEQ ID NO: 611 - protein, 210 aa, synthetic construct
MCLNDEGGPSSLSSHRWSTFLKVELECDIDGRSYRQIIHSRTIKTDNDTILYVFFDSPYSKSALCTYSMNTIKQSFSTSKLEGYTKQLPSPAPGICLPAGKVVPHTTFEVIEKYNVLDDIIKPLSNQPIFEGPSGVKWFDIKEKENEHREYRIYFIKENSIYSFDTKSKQTRSSQVDARLFSVMVTSKPLFIADIGIGVGMPQMKKILKM

SEQ ID NO: 612 - protein, 81 aa, synthetic construct
MNKHKTDYAGYACCVICGLIVGIIFTATLLKVVERKLVHTPSIDKTIKDAYIREDCPTDWISYNNKCIHLSTDRKNLGGRT

SEQ ID NO: 613 - protein, 219 aa, synthetic construct
MYSLLFIILMCIPFSFQTVYDDKSVCDSDNKEYMGIEVYVEATLDEHLRQTTCESEIHKYGASVSNGGLNISVDLLNCFLNFHTVGVYTNRDTVYAKFASLDPWTTEPINSMTHDDLVKLTEECIVDIYLKCEVDKTKDFMKTNGNRLKPRDFKTVPPSDVGSMIELQSDYCVNDVTAYVKIYDECGNIKQHSIPTLRDYFTTKNGQPRKILKKKFDNC

SEQ ID NO: 614 - protein, 133 aa, synthetic construct
MAEWHKIIEDISKNNKFEDAAIVDYKTTKNVLAAIPNRTFAKINPGEIIPLITNRNILKPLIGQKYCIVYTNSLMDENTYAMELLTGYAPVSPIVIARTHTALIFLMGKPTTSRRDVYRTCRDHATRVRATGN

SEQ ID NO: 615 - protein, 194 aa, synthetic construct
MMMMKWIISILTMSIMPVLAYSSSIFRFHSEDVELCYGHLYFDRIYNVVNIKYNPHIPYRYNFINRTLTVDELDDNVFFTHGYFLKHKYGSLNPSLIVSLSGNLKYNDIQCSVNVSCLIKNLATSTSTILTSKHKTYSLHRSTCITIIGYDSIIWYKDINDKYNDIYDFTAICMLIASTLIVTIYVFKKIKMNS

SEQ ID NO: 616 - protein, 78 aa, synthetic construct
MLLEMDKIKITVDSKIGNVVTISYNLEKITIDVTPKKKKEKDVLLAQSVAVEEAKDVKVEEKNIIDIEDDDDMDVESA

SEQ ID NO: 617 - protein, 346 aa, synthetic construct
MAVYAVTGGAGFLGRYIVKLLISADDVQEIRVIDIVEDPQPITSKVKVINYIQCDINDFDKVREALDGVNLIIHTAALVDVFGKYTDNEIMKVNYYGTQTILAACVDLGIKYLIYTSSMEAIGPNKHGDPFIGHEHTLYDISPGHVYAKSKRMAEQLVMKANNSVIMNGAKLYTCCLRPTGIYGEGDKLTKVFYEQCKQHGNIMYRTVDDDAVHSRVYVGNAAWMHVLAAKYIQYPGSKIKGNAYFCYDYSPSCSYDMFNLLLMKPLGIEQGSRIPRWMLKMYACKNDMKRILFRKPSLLNNYTLKISNTTFEVRTNNAELDFNYSPIFNVDVAFERTRKWLEESE

SEQ ID NO: 618 - protein, 125 aa, synthetic construct
MAVCIIDHDNIRGVIYFEPVHGKDKVLGSVIGLKSGTYSLIIHRYGDISQGCDSIGSPEIFIGNIFVNRYGVAYVYLDTDVNIFTIIGKALSISKNDQRLACGVIGISYINEKIIHFLTINENGV

SEQ ID NO: 619 - protein, 240 aa, synthetic construct
MAFDISVNASKTINALVYFSTQQNKLVIRNEVNDTHYTVEFDRDKVVDTFISYNRHNDTIEIRGVLPEETNIGCAVNTPVSMTYLYNKYSFKLILAEYIRHRNTISGNIYSALMTLDDLAIKQYGDIDLLFNEKLKVDSDSGLFDFVNFVKDMICCDSRIVVALSSLVSKHWELTNKKYRCMALAEHISDSIPISELSRLRYNLCKYLRGHTESIEDEFDYFEDDDSSTCSAVTDRETDV

SEQ ID NO: 620 - protein, 244 aa, synthetic construct
MGNKNIKPSKENRLSILSKDKMDSFKRGSWATSSFKEKSRATIQRFSSLRREHIKVDHPDKFLELKRGIYEIIQKSSSIDVDKRTKLMSNIKTMMINPFMIEGLMTSLENLDPDNKMSYSSVMILGEFDIINISDNEAAFEFINSLLKSLLLLNTRQLKLLEYSISNDLLYAHINALEYIIKNTFNVPERQLILRGQYLTPIFSDLLKYAGLTIKSNILMWNKQFIKPVSDLYTSIRLLYCVTV

SEQ ID NO: 621 - protein, 204 aa, synthetic construct
MSRGALIVFEGLDKSGKTTQCMNIMESIPANTIKYLNFPQRSTVTGKMIDDYLTRKKTYNDHIVNLLFCANRWEFASFIQEQLEQGITLIVDRYAFSGVAYAAAKGASMTLSKSYESGLPKPDLVIFLESGSKEINRNVGEEIYEDVTFQQKVLQEYKKMIEEGDIHWQIISSEFEEDVKKELIKNIVIEAIHTVTGPVGQLWM

SEQ ID NO: 622 - protein, 162 aa, synthetic construct
MDEAYYSGNLESVLGYVSDMHTELASISQLVIAKIETIDNDILNKDIVNFIMCRSNLDNPFISFLDTVYTIIDQEIYQTELINSLDDNEIIDCIVNKFMSFYKDNLENIVDAIITLKYIMNNPDFKTTYAEVLGSRIADIDIKQVIRKNILQLSNDIRERYL

SEQ ID NO: 623 - protein, 552 aa, synthetic construct
MTSLREFRKLCCDIYHASGYKEKSKLIRDFITDRDDKYLIIKLLLPGLDDRIYNMNDKQIIKLYSIIFKQSQEDMLQDLGYGYIGDTIRTFFKENTEIRPRDKSILTLEEVDSFLTTLSSVTKESHQIKLLTDVASVCTCNDLKCVVMLIDKDLKIKAGPRYVLNAISPHAYDVFRKSNNLKEIIENASKQNLDSISISVMTPINPMLAESCDSVNKAFKKFPSGMFAEVKYDGERVQVHKNNNEFAFFSRNMKPVLSHKVDYLKEYIPKAFKKATSIVLDSEIVLVDEHNVPLPFGSLGIHKKKEYKNSNMCLFVFDCLYFDGFDMTDIPLYERRSFLKDVMVEIPNRIVFSELTNISNESQLTDVLDDALTRKLEGLVLKDINGVYEPGKRRWLKIKRDYLNEGSMADSADLVVLGAYYGKGAKGGIMAVFLMGCYDDESGKWKTVTKCSGHDDNTLRELQDQLKMIKINKDPKKIPEWLVVNKIYIPDFVVEDPKQSQIWEISGAEFTSSKSHTANGISIRFPRFTRIREDKTWKESTHLNDLVNLTKS

SEQ ID NO: 624 - protein, 334 aa, synthetic construct
MDGVIVYCLNALVKHGEEINHIKNDFMIKPCCERVCEKVKNVHIGGQSKNNTVIADLPYMDNAVSDVCNSLYKKNVSRISRFANLIKIDDDDKTPTGVYNYFKPKDVIPVIISIGKDKDVCELLISSDISCACVELNSYHVAILPMNVSFFTKGNASLIILLFDFSIDAAPLLRSVTDNNVIISRHQRLHDELPSSNWFKFYISIKSDYCSILYMVVDGSVMHAIADNRTHAIISKNILDNTTINDECRCCYFEPQIRILDRDEMLNGSSCDMNRHCIMMNLPDVGEFGSSMLGKYEPDMIKIALSVAGNLIRNRDYIPGRRGYSYYVYGIASR

SEQ ID NO: 625 - protein, 190 aa, synthetic construct
MDIKIDISISGDKFTVTTRRENEERKKYLPLQKEKTTDVIKPDYLEYDDLLDRDEMFTILEEYFMYRGLLGLRIKYGRLFNEIKKFDNDAEEQFGTIEELKQKLRLNSEEGADNFIDYIKVQKQDIVKLTVYDCISMIGLCACVVDVWRNEKLFSRWKYCLRAIKLFINDHMLDKIKSILQNRLVYVEMS

SEQ ID NO: 626 - protein, 107 aa, synthetic construct
MTRWWRSRYICRSQCSNVKNSTCSQQILYIHLLILSYTTITKSFFKTLNHHQKSMFKVIRLKYIFEINSCISYPSILDLYIFEINSCISHPSILDLYVLKNTILLIL

SEQ ID NO: 627 - protein, 132 aa, synthetic construct
MIILKDGYKEFADCMYYFLHYYIGYGRYTYSATNGSCDKGEYLDKRHNQCCNRCPPGEFAKVRCNGNDNTKCERCPPHTYTTIPNYSNGCHQCRKCPTGSFDKVKCTGTQNSKCSCLPGWYCATDSSQTEDC

SEQ ID NO: 628 - protein, 59 aa, synthetic construct
MNKEILFVNRAVLVNIATTYVIIDLIHFLHANYLNVINYDFDDNVTIHYIATWLVYYSV

SEQ ID NO: 629 - protein, 564 aa, synthetic construct
MNSSSKLIAVINGFRNSGRFCDINIVINDERINAHRLILSGASEYFSILFSNNFIDSNEYEVNLSHLDYQSVNDLIDYIYGIPLSLTNDNVKYILSTADFLQIGSAITECEKYILKNLCSRNCIDFYIYADKYNNKKIESASFNTILRNILRLINDENFKYLTEESMIKILSDDMLNIKNEDFAPLILIKWLESTQQSCTVELLRCLRISLLSPQVIKSLYSHQLVSSIYECITFLNNIAFLDESFPRYHSIELISIGISNSHDKISINCYNHKKNTWEMISSRRYRCSFAVAVLDNIIYMMGGYDQSPYRSSKVIAYNTCTNSWIYDIPELKYPRSNCGGLADDEYIYCIGGIRDQDSSLTSSIDRWKPSKPYWQKYAKMREPKCDMGVAMLNGLIYVMGGIVKGDTCTDALESLSEDGWMKHQRLPIKMSNMSTIVHDGKIYISGGYNNSSVVNVISNLVLSYNPIYDEWTKLSSLNIPRINPALWSAHNKLYVGGGISDDVRTNTSETYDKEKDCWTLDNGHVLPRNYIMYKCEPIKHKYPLEKTQYTNDFLKYLESFIGS

SEQ ID NO: 630 - protein, 315 aa, synthetic construct
MTRLPILLLLISLVYATPFPQTSKKIGDDATLSCNRNNTNDYVVMSAWYKEPNSIILLAAKSDVLYFDNYTKDKISYDSPYDDLVTTITIKSLTARDAGTYVCAFFMTSTTNDTDKVDYEEYSTELIVNTDSESTIDIILSGSTHSPETSSEKPEDIDNFNCSSVFEIATPEPITDNVEDHTDTVTYTSDSINTVSASSGESTTDETPEPITDKEEDHTVTDTVSYTTVSTSSGIVTTKSTTDDADLYDTYNDNDTVPPTTVGGSTTSISNYKTKDFVEIFGITALIILSAVAIFCITYYIYNKRSRKYKTENKV

SEQ ID NO: 631 - protein, 151 aa, synthetic construct
MEREGVDYHYVNREAIWKGIAAGNFLEHTEFLGNIYGTSKTAVNTAAINNRICVMDLNIDGVRSLKNTYLMPYSVYIRPTSLKMVETKLRCRNTEADDEIHRRVMLAKTDMDEAGEAGLFDTIIIEDDVNLAYSKLIQILQDRIRMYFNTN

SEQ ID NO: 632 - protein, 300 aa, synthetic construct
MNFQGLVLTDNCKNQWVVGPLIGKGGFGSIYTTNDNNYVVKIEPKANGSLFTEQAFYTRVLKPSVIEEWKKSHNIKHVGLITCKAFGLYKSINVEYRFLVINRLGADLDAVIRANNNRLPKRSVMLIGIEILNTIQFMHEQGYSHGDIKASNIVLDQIDKNKLYLVDYGLVSKFMSNGEHVPFIRNPNKMDNGTLEFTPIDSHKGYVVSRRGDLETLGYCMIRWLGGILPWTKISETKNCALVSATKQKYVNNTATLLMTSLQYAPRELLQYITMVNSLTYFEEPNYDEFRHILMQGVYY

SEQ ID NO: 633 - protein, 219 aa, synthetic construct
MAMFYAHALGGYDENLHAFPGISSTVANDVRKYSVVSVYNNKYDIVKDKYMWCYSQVNKRYIGALLPMFECNEYLQIGDPIHDQEGNQISIITYRHKNYYALSGIGYESLDLCLEGVGIHHHVLETGNAVYGKVQHDYSTIKEKAKEMNALSSGPIIDYHVWIGDCICQVTAVDVHGKEIMRMRFKKGAVLQIPNLVKVKLGENDTENLSSTISAAPSR

SEQ ID NO: 634 - protein, 124 aa, synthetic construct
MKRLETIRHMWSVVYDHFDIVNGKECCYVHTHSSNQNPIPSTVKTNLYMKTMGSCIQMDSMEALEYLSELKESGGWSPRPEMQEFEYPDGVEDTESIERLVEEFFNRSELQAGKLVKFGNSINC

SEQ ID NO: 635 - protein, 558 aa, synthetic construct
MDFFKKEILDWSVYLSLHYIARVCSNSSTSHIIQDYNLVRTYEKVDKTIVDFLSRLPNLFHILEYGENILHIYSMDDANTNIIIFFLDRVLNINKNGSFIHNLRLSSSINIKEYVYQLVNNDHPDNRIRLMLENGRRTRHFLSYISDTVNIYICILINHGFYIDAEDSYGCTLLHRCIYHYKKSESESYNELIKILLNNGSDVDKKDTYGNTPFILLCKHDINNVELFEICLENANIDSVDFNRYTPLHYVSCRNKYDFVKLLISKGANVNARNKFGTTPFYCGIIHGISLIKLYLESDTELEIDNEHIVRHLIIFDAVESLDYLLSRGVIDINYRTIYNETSIYDAVSYNAYNTLVYLLNRNGDFETITTSGCTCISEAVANNNKIIMEVLLSKRPSLKIMIQSMIAITKNKQHNADLLKMCIKYTACMTDYDTLIDVQSLQQYKWYILKCFDEIDIMKRCYIKNKTVFQLVFCIKDINTLMRYGKHPSFVKCTSLDVYGSRVRNIIASIRYRQRLISLLSKKLDAGDKWSCFPNEIKYKILENFNDNELSTYLKIL

SEQ ID NO: 636 - protein, 317 aa, synthetic construct
MKTISVVTLLCVLPAVVYSTCTVPTMNNAKLTSTETSFNDKQKVTFTCDQGYHSLDPNAVCETDKWKYENPCKKMCTVSDYVSELYDKPLYEVNSTMTLSCNGETKYFRCEEKNGNTSWNDTVTCPNAECQPLQLEHGSCQPVKEKYSFGEYMTINCDVGYEVIGASYISCTANSWNVIPSCQQKCDIPSLSNGLISGSTFSIGGVIHLSCKSGFILTGSPSSTCIDGKWNPILPTCVRSNEKFDPVDDGPDDETDLSKLSKDVVQYEQEIESLEATYHIIIVALTIMGVIFLISVIVLVCSCDKNNDQYKFHKLLP

SEQ ID NO: 637 - protein, 173 aa, synthetic construct
MSSSVDVDIYDAVRAFLLRHYYNKRFIVYGRSNAILHNIYRLFTRCAVIPFDDIVRTMPNESRVKQWVMDTLNGIMMNERDVSVSVGTGILFMEMFFDYNKNSINNQLMYDIINSVSIILANERYRSAFNDDGIYIRRNMINKLYGYASLTTIGTIAGGVCYYLLMHLVSLYK

SEQ ID NO: 638 - protein, 182 aa, synthetic construct
MYKKLITFLFVIGALASYSNNEYTPFNKLSVKLYIDGVDNIENSYTDDNNELVLNFKEYTISIITESCDVGFDSIDIDVINDYKIIDMYTIDSSTIQRRGHTCRISTKLSCHYDKYPYIHKYDGDEQQYSITAEGKCYKGIKYEISMINDDTLLRKHTLKIGSTYIFDRHGHSNTYYSKYDF

SEQ ID NO: 639 - protein, 272 aa, synthetic construct
MRYIIILAVLFINSIHAKITSYKFESVNFDSKIEWTGDGLYNISLKNYGIKTWQTMYTNVPEGTYDISAFPKNDFVSFWVKFEQGDYKVEEYCTGLCVEVKIGPPTVTLTEYDDHINLYIEHPYATRGSKKIPIYKRGDMCDIYLLYTANFTFGDSKEPVPYDIDDYDCTSTGCSIDFVTTEKVCVTAQGATEGFLEKITPWSSKVCLTPKKSVYTCAIRSKEDVPNFKDKMARVIKRKFNKQSQSYLTKFLGSTSNDVTTFLSMLNLTKYS

SEQ ID NO: 640 - protein, 57 aa, synthetic construct
MNTAISSFGIEIFGNYTQPYFQSPCFLFSLLTSSNRHGVDDRGEQKDYNQGPHLENG

SEQ ID NO: 641 - protein, 77 aa, synthetic construct
MRSLIIVLLFPSIIYSMSIRRCEKTEEETWGLKIGLCIIAKDFYPERTDCSVHLPTASEGLITEGNGFRDIRNTDKL

SEQ ID NO: 642 - protein, 166 aa, synthetic construct
MDSGIYETPINYKKSNVSAVSVNNTIFVTGGLFINNSNSTIVVNNMEKLDIYKDKQWSIIEMPMARVYHGIDSTFGMLYFAGGLSVTEQYGNLEKNNEISCYNPRTNKWFDISYTIYKISISSLCKLNNVFYVFSKDIGYVEKYDGAWKLVHDRLPAIKALSTSPY

SEQ ID NO: 643 - protein, 283 aa, synthetic construct
MESFKYCFDNDGKKWIIGNTLYSGNSILYKVRKNFTSSFYNYVMKIDHKSHKPLLSEIRFYISVLDPLTIDNWTRERGIKYLAIPDLYGIGETDDYMFFVIKNSGRVFAPKDTESVFEACVTMINTLEFIHSRGFTHGKIEPRNILIRNKRLSLIDYSRTNKLYKSGNSHIDYNEDMITSGNINYMCVDNHLGATVSKRGDLEMLGYCMIEWFGGKLPWKNESSIKVIKQKKEYKKFIATFFEDCFPEGNEPLELVRYIELVYTLDYSQTPNYDRLRKLFIQD

SEQ ID NO: 644 - protein, 345 aa, synthetic construct
MDIFREIASSMKGENVFISPASISSVLTILYYGANGSTAEQLSKYVETEENTDKVSAQNISFKSMNKVYGRYSAVFKDSFLRKIGDKFQTVDFTDCRTIDAINKCVDIFTEGKINPLLDEPLSPDTCLLAISAVYFKAKWLMPFEKEFTSDYPFYVSPTEMVDVSMMSMYGKAFNHASVKESFGNFSIIELPYVGDTSMMVILPDKIDGLESIEQNLTDTNFKKWCNSLEATFIDVHIPKFKVTGSYNLVDTLVKSGLTEVFGSTGDYSNMCNSDVSVDAMIHKTYIDVNEEYTEAAAATCALVSDCASTITNEFCVDHPFIYVIRHVDGKILFVGRYCSPTTNC

SEQ ID NO: 645 - protein, 149 aa, synthetic construct
MTANFSTHVFSPQHCGCDRLTSIDDVRQCLTEYIYWSSYAYRNRQCAGQLYSTLLSFRDDAESVFIDIRELVKNMPWDDVKDCTEIIRCYIPDEQKTIREISAIIGLCAYAATYWGGEDHPTSNSLNALFVMLEMLNYVDYNIIFRRMN

SEQ ID NO: 646 - protein, 326 aa, synthetic construct
MSILPIIFLPIFFYSSFVQTFNAPECIDKGQYFASFMELENEPVILPCPQINTLSSGYNILDILWEKRGADNDRIIPIDNGSNMLILNPTQSDSGIYICITTNETYCDMMSLNLTIVSVSESNIDLISYPQIVNERSTGEMVCPNINAFIASNVNADIIWSGHRRLRNKRLKQRTPGIITIEDVRKNDAGYYTCVLEYIYRGKTYNVTRIVKLEVRDKIIPSTMQLPDGIVTSIGSNLTIACRVSLRPPTTDADVFWISNGMYYEEDDGDGDGRISVANKIYMTDKRRVITSRLNINPVKEEDATTFTCMAFTIPSISKTVTVSIT

SEQ ID NO: 647 - protein, 340 aa, synthetic construct
MSRKFMQVYEYDREQYLDEFIEDRYNDSFITSPEYYSAEKYMCRYTTLNHNCINVRRCALDSKLLHDIITNCKIYNNIELVRATKFVYYLDLIKCNWVSKVGDSVLYPVIFITHTSTRNLDKVSVKTYKGVKVKKLNRCADHAIVINPFVKFKLTLPNKTSHAKVLVTFCKLRTDITQIEAPLSGNVLVYTFPDINKRIPGYIHVNIEGCIDGMIYINSSKFACVLKLHRSMYRIPPFPIDICSCCSQYTNDDIEIPIHDLIKDVAIFKNKETVYYLKLNNKTIARFTYFNNIDTAITQEHEYVKIALGIVCKLMINNMHSIVGVNHSNTFVNCLLEDNV

SEQ ID NO: 648 - protein, 574 aa, synthetic construct
MSRRLIYVLNINRKSTHKIQENEIYTYFSHCNIDHTSTELDFVVKNYDLNRRQHVTGYTALHCYLYNNYFTNDVLKILLNHDVNVTMKTSSGRMPVYILLTRCCNISHDVVIDMIDKDKNHLLHRDYSNLLLEYIKSRYMLLKEEDIDENIVSTLLDKGIDPNFKQDGYTALHYYYLCLAHVYKPGECRKPITIKKAKRIISLFIQHGANLNALDNCGNTPFHLYLSIEMCNNIHMTKMLLTFNPNFKICNNHGLTPILCYITSDYIQHDILVMLIHHYETNVGEMPIDERRMIVFEFIKTYSTRPADSITYLMNRFKNINIYTRYEGKTLLHVACEYNNTHVIDYLIRINGDINALTDNNKHATQLIIDNKENSPYTIDCLLYILRYIVDKNVIRSLVDQLPSLPIFDIKSFEKFISYCILLDDTFYDRHVKNRDSKTYRYAFSKYMSFDKYDGIITKCHDETMLLKLSTVLDTTLYAVLRCHNSKKLRRYLNELKKYNNDKSFKIYSNIMNERYLNVYYKDMYVSKVYDKLFPVFTDKNCLLTLLPSEIIYEILYMLTINDLYNISYPPTKV

SEQ ID NO: 649 - protein, 351 aa, synthetic construct
MTMKMMVHIYFVSLLLLLFHSYAIDIENEITEFFNKMRDTLPAKDSKWLNPACMFGGTMNDIAALGEPFSAKCPPIEDSLLSHRYKDYVVKWERLEKNRRRQVSNKRVKHGDLWIANYTSKFSNRRYLCTVTTKNGDCVQGIVRSHIKKPPSCIPKTYELGTHDKYGIDLYCGILYAKHYNNITWYKDNKEINIDDIKYSQTGKKLIIHNPELEDSGRYNCYVHYDDVRIKNDIVVSRCKILTVIPSQDHRFKLILDPKINVTIGEPANITCTAVSTSLLIDDVLIEWENPSGWLIGFDFDVYSVLTSRGGITEATLYFENVTEEYIGNTYKCRGHNYYFEKTLTTTVVLE

SEQ ID NO: 650 - protein, 318 aa, synthetic construct
MEMYPRHRYSKHSVFKGFSDKVRKNDLDMNVVKELLSNGASLTIKDSSNKDPITVYFRRTIMNLEMIDIINKHTTIDERKYIVHSYLKNYKNFDYPFFRKLVLTNKHCLNNYYNISDSKYGTPLHILASNKKLITPNYMKLLVYNGNDINARGEDTQMRTPLHKYLCKFVYHNIEYGIRYYNEKIIDAFIELGADLTIPNNDGMIPVVYCIHSNAEYGYNNITNIKIIRKLLNLSRRASHNLFRDRVMHDYISNTYIDLECLDIIRSLDGFDINGYFEGRTPLHCAIQHNFTQIAKYLLDRGADIVVPNTLIIHQYIQ

SEQ ID NO: 651 - protein, 134 aa, synthetic construct
MEEDTNISNKVIRYNTVNNIWKTLPNFWTGTINPGVVSHKDDIYVVCDIKDEKNVKTCIFRYNTNTYNGWELVTTTESRLSALHTILHDNTIMMLHCYESYMLQDTFNVYTREWNHMCHQHSNSYIMYNILPIY

SEQ ID NO: 652 - protein, 357 aa, synthetic construct
MDIFKELILKHPDENVLISPVSILSTLSILNHGAAGSTAEQLSKYIENMNENTPDDKKDDNNDMDVDIPYCATLATANKIYGSDSIEFHASFLQKIKDDFQTVNFNNANQTKELINEWVKTMTNGKINSLLTSPLSINTRMTVVSAVHFKAMWKYPFSKHLTYTDKFYISKNIVTSVDMMVGTENNLQYVHINELFGGFSIIDIPYEGNSSMVIILPDDIEGIYNIEKNITDEKFKKWCGMLSTKSIDLYMPKFKVEMTEPYNLVPILENLGLTNIFGYYADFSKMCNETITVEKFLHTTFIDVNEEYTEASAVTGVFMTNFSMVYRTKVYINHPFMYMIKDNTGRILFIGKYCYPQ

SEQ ID NO: 653 - protein, 190 aa, synthetic construct
MMIYGLIACLIFVTSSIASPLYIPVIPPITEDKSFNSVEVLVSLFRDDQKDYTVTSQFNNYTIDTKDWTIGVLSTPDGLDIPLTNITYWSRFTIGRALFKSESEDIFQKKMSILGVSIECKKSSTLLTFLTVRKMTRVFNKFPDMAYYRGDCLKAVYVTMTYKNTKTGETDYTYLSNGGLPAYYRNGVDG

SEQ ID NO: 654 - protein, 42 aa, synthetic construct
MRDVRPEYWMGLDVAVFLFFATSDVDRHLTVFPSADSEMDLI

SEQ ID NO: 655 - protein, 27 aa, synthetic construct
MDSLRPVVVVRVHDVSLTGYRLISTSI

SEQ ID NO: 656 - protein, 32 aa, synthetic construct
MTTGDIILTLEGKSSSRIKAYLIQANNGSGYR

SEQ ID NO: 657 - protein, 31 aa, synthetic construct
MAVLIIERDVVTLAPYSNNRFANCILLTSTA

SEQ ID NO: 658 - protein, 30 aa, synthetic construct
MRRYIVMKRVLTHITVVHTGTKYVTGAVTF

SEQ ID NO: 659 - protein, 37 aa, synthetic construct
MVYVDLRTIYHRKVSHKYSCNGRCFCILLINIYKRRM

SEQ ID NO: 660 - protein, 56 aa, synthetic construct
MYILQVILGTHHHINTGNYILRNIKLVCICKMFRKWIFPHCFKMDGANNCHTSING

SEQ ID NO: 661 - protein, 29 aa, synthetic construct
MTRSLNRLCDARLLRLSSLRIIFMLVILL

SEQ ID NO: 662 - protein, 36 aa, synthetic construct
MYLSNSDFFSHVCVDTSLVIGDMCSASSTSDTLSIL

SEQ ID NO: 663 - protein, 31 aa, synthetic construct
MDFPIQSVHRQSIMTLTQQCMLYWQVLLSLR

SEQ ID NO: 664 - protein, 39 aa, synthetic construct
MIITYFEIRIKSQQHFSHMNIITHFNTKIQMEWCITTII

SEQ ID NO: 665 - protein, 35 aa, synthetic construct
MLYKQRNNSLGLFYRYRFSTLTWFINVCETQIIIM

SEQ ID NO: 666 - protein, 48 aa, synthetic construct
MISVQSLTSSHGIFFTSSRMSMNTDSASSLKERSVEYNCPAHCLLRYA

SEQ ID NO: 667 - protein, 37 aa, synthetic construct
MDSNPSILSGRMTIILVSPTYGSSMIEKLPNDSFTDA

SEQ ID NO: 668 - protein, 27 aa, synthetic construct
MNTFSPFIEDAISLKISIVIDIGRVAR

SEQ ID NO: 669 - protein, 39 aa, synthetic construct
MSSFSILLTTIVLLELFMNNPPVTKIVLLTETADTLLFL

SEQ ID NO: 670 - protein, 57 aa, synthetic construct; identical to SEQ ID NO: 640

SEQ ID NO: 671 - protein, 40 aa, synthetic construct
MQFYFVFVSLIKISYEYLVKLSMLRKVVTSFDVLPRNLVK

SEQ ID NO: 672 - protein, 33 aa, synthetic construct
MYKLIWSSYSVNVTVGGPIFTSTHSPVQYSSTL

SEQ ID NO: 673 - protein, 41 aa, synthetic construct
MESNPTSHDSVIIEIVYSLKFNTNSLLSSVYEFSILSTPSI

SEQ ID NO: 674 - protein, 43 aa, synthetic construct
MAYHIIQRHNQKLCTFSCMDFRISIYLFRRQHLDPKNDIPDHM

SEQ ID NO: 675 - protein, 45 aa, synthetic construct
MILRTRLPYTSRLVHFTKEGCLPYLIKVLMSLIQKTNWNTVLFFI

SEQ ID NO: 676 - protein, 26 aa, synthetic construct
MISISSKHFKIYHLYCCSDCTSIRVS

SEQ ID NO: 677 - protein, 36 aa, synthetic construct
MDDDNLRLCINDPFLLIFNTLSRKKIIIFVLASSIE

SEQ ID NO: 678 - protein, 34 aa, synthetic construct
MNRHVYLMSSFFSQKCTTQSLLICFSISFSISLR

SEQ ID NO: 679 - protein, 44 aa, synthetic construct
MNKYPPFVLVKDESIKGSCCRIRVLSCLAETDVCLTINRITKFD

SEQ ID NO: 680 - protein, 95 aa, synthetic construct
MRMHITAFFTIHNIKMIIYNRPHMAYSFQTFHEYIIHAVFLRGGYLDGAADIVEERFSVSFSPSLTFTRFGICSTAPFLNLILIISFPCTSTAVT

SEQ ID NO: 681 - protein, 45 aa, synthetic construct
MAVFPEPDGPLNMIDFTIPDIYVSQKSRLCSLFCIYVNVYYIYNM

SEQ ID NO: 682 - protein, 43 aa, synthetic construct
MTYINPFNIATPISHFGSRILAYFCQYGFDGFHLSILDVNDES

SEQ ID NO: 683 - protein, 41 aa, synthetic construct
MYSSSASPPQLERGYFSSGISYIQEFVHVLYAITFELLYGD

SEQ ID NO: 684 - protein, 38 aa, synthetic construct
MEILSCELLIPIDINSMLWYLGNDSSKNAILFKNVIHS

SEQ ID NO: 685 - protein, 62 aa, synthetic construct
MRISGAKSSFFIFNISSLKIFIIDSSVKYLKFSSLMSLKIFRNIVLNDADSIFLLLYLSAYM

SEQ ID NO: 686 - protein, 34 aa, synthetic construct
MYFSHSVMADPICKKSAVERIYFTLSLVRLKGIP

SEQ ID NO: 687 - protein, 55 aa, synthetic construct
MTSIRIIGDCGICMRWAAFTFCVIVTITSNLGKFSRWTPITTLIMPLIKIFSLVT

SEQ ID NO: 688 - protein, 25 aa, synthetic construct
MNLTPRMHTICLMRLIVHRHLYPFL

SEQ ID NO: 689 - protein, 67 aa, synthetic construct
MSVISNPSKYKQSNTNKHMLEFLYSFFLCIPKLPNGSGTLCSSTRTISESNTIDVAFLNAFGMYSLR

SEQ ID NO: 690 - protein, 35 aa, synthetic construct
MGLIGVITEIDIESRFCLDAFSIISFKLLDFLNTS

SEQ ID NO: 691 - protein, 33 aa, synthetic construct
MLLSRGRISVFSLKKVLIVSPIYPYPKSCSISS

SEQ ID NO: 692 - protein, 25 aa, synthetic construct
MIKYLSSLSVIKSLINLDFSLYPDA

SEQ ID NO: 693 - protein, 30 aa, synthetic construct
MRVRYAYRTRIRVLIPSCQSNMLHPFITLY

SEQ ID NO: 694 - protein, 105 aa, synthetic construct
MLSVCPRRYLHRLYRSLDSSDIGILSDICSANAIHLYFLFVNSQCLDTRLDRATTILESQHIISFTKLTKSNSPESESTLSFSLNNRSMSPYCLIAKSSSVINAE

SEQ ID NO: 695 - protein, 25 aa, synthetic construct
MDWFKVNNSSDIIVVYYTNSHYLVK

SEQ ID NO: 696 - protein, 26 aa, synthetic construct
MSGSNGRVRGYWWCRISRQVYSKTVN

SEQ ID NO: 697 - protein, 32 aa, synthetic construct
MEYADYILYLLHYRSYQNTNAHNIIPHPLNEI

SEQ ID NO: 698 - protein, 36 aa, synthetic construct
MSCMPIPALLTSSIWILSISSSSFKIDTTYEYYFLF

SEQ ID NO: 699 - protein, 27 aa, synthetic construct
MRGIISPGLILANVLLGIAARTFFVVL

SEQ ID NO: 700 - protein, 36 aa, synthetic construct
MAASSNLLFFEISSIILCHSAIVIYYICFLIRHLLE

SEQ ID NO: 701 - protein, 27 aa, synthetic construct
MDTFIIIAYPVSRTIFSNICIFYRFIY

SEQ ID NO: 702 - protein, 29 aa, synthetic construct
MLLVNHLLELRYPPCINHNHMVRQIFSIV

SEQ ID NO: 703 - protein, 32 aa, synthetic construct
MRSIFVLSVNVYSPAYYWIVDDDVTIYISYNY

SEQ ID NO: 704 - protein, 29 aa, synthetic construct
MRCTPHYLLSIGRIHFNGFGFGIEFKGMC

SEQ ID NO: 705 - protein, 53 aa, synthetic construct
MCIIPRASRRGRGTRNYCYFIIILDLILILFIRFFASSFISRYTTEFHKKRRE

SEQ ID NO: 706 - protein, 83 aa, synthetic construct
MLIFILSILPYNICSLIGTELYDCIFLYTKSNGCSRLQTCIKVSCSMLEFMYLAEDIPIQFDGIGNCLLSMVIMEYHLLFANI

SEQ ID NO: 707 - protein, 40 aa, synthetic construct
MSFVNDVTNRLLGISALTTNMVVGPLLTTTHLLSGDMITA

SEQ ID NO: 708 - protein, 33 aa, synthetic construct
MGKVRIFLPLTSLSIEITHPPTELIQSIIVDNL

SEQ ID NO: 709 - protein, 31 aa, synthetic construct
MCSVLGAITLDSLSHIKLPAKLSSSNISFLE

SEQ ID NO: 710 - protein, 53 aa, synthetic construct
MSEVSSVAPSDADPSTYLTSSSDDSLHMSPIRTLNSRFLTHFVSTIVEPMISS

SEQ ID NO: 711 - protein, 38 aa, synthetic construct
MLDPSTGWVLMSLSFSSSLHLMSIDTSQSFHQRILRWI

SEQ ID NO: 712 - protein, 32 aa, synthetic construct
MIVSFFAFVNCLEEESLLLHLISKFRVHTFLL

SEQ ID NO: 713 - protein, 32 aa, synthetic construct
MTRPLIGSRLVSFLRSNRRRERHLVEQRFNHR

SEQ ID NO: 714 - protein, 31 aa, synthetic construct
MRQHCCYNFERRYYSIRLSECRTYLVDTVVY

SEQ ID NO: 715 - protein, 32 aa, synthetic construct
MMGVQSRLLRILVSAPRDKRAYTTRGLCLVYC

SEQ ID NO: 716 - protein, 70 aa, synthetic construct
MRRCIHIKERKIHMTNIVDRNVTFILTVVHKYVRYVPHTVANDAYNLVHLIMIYFFIIKDVKEKQNNIFF

SEQ ID NO: 717 - protein, 28 aa, synthetic construct
MGKDPPSSLPWMETLLLIKHLITSLDRD

SEQ ID NO: 718 - protein, 46 aa, synthetic construct
MMKAIIPHKMIKSVVREHEGDLVFSSADMIQEGEIVVLVQNLSQHK

SEQ ID NO: 719 - protein, 57 aa, synthetic construct
MGPSMRNPQDVFSQTMSDVGHGIQGVLSSVAMTGSELGTRRGHCKGRPVAVYANRGL

SEQ ID NO: 720 - protein, 58 aa, synthetic construct
MLYIPSMSSGSIITILEFPSYGISIIENPPNNSLICTYCKLFSVPTIISTLVTIFLEI

SEQ ID NO: 721 - protein, 36 aa, synthetic construct
MDSGLVNKELILPFVIVLTHSLISSFVWLALLKFTV

SEQ ID NO: 722 - protein, 32 aa, synthetic construct
MSLLSSFLSSGVFSFIFSIYFDSCSAVEPAAP

SEQ ID NO: 723 - protein, 59 aa, synthetic construct
MSHTTYISSLCETTPGFIVPVQKLGNVFHILLTVLYLITLFEIFVSSSISMLFTVCTDV

SEQ ID NO: 724 - protein, 25 aa, synthetic construct
MEFAFVYLHLVRLYHFRYTLITSCN

SEQ ID NO: 725 - protein, 33 aa, synthetic construct
MRSNYTLNTVTILCSYGTQIPTVTEFRCIVGYP

SEQ ID NO: 726 - protein, 27 aa, synthetic construct
MYHHFHRHLYYTALKYLYNISFFTHIA

SEQ ID NO: 727 - protein, 37 aa, synthetic construct
MYNISYIISEGSNVSRQFLSVKTGNSLSYTFDTYISL

SEQ ID NO: 728 - protein, 33 aa, synthetic construct
MVYGEFSLLSIMSCVACLLLSVNAFISPLIRIR

SEQ ID NO: 729 - protein, 340 aa, synthetic construct; identical to SEQ ID NO: 647

SEQ ID NO: 730 - protein, 41 aa, synthetic construct
MSAPYNICVYVTSNKCINIGTYHFASRSLIYYLWIRDKIYI

SEQ ID NO: 731 - protein, 43 aa, synthetic construct
MFLLFSISTFFSISSFSLSISFMISSTFVTSVSMLVVSNKTIG

SEQ ID NO: 732 - protein, 38 aa, synthetic construct
MIEGNRRTIIRDLILKMVRAYKGVNQCIICSFISFLYH

SEQ ID NO: 733 - protein, 28 aa, synthetic construct
MLQSVVQFLLRRIVPYNTLPLYNRLVQI

SEQ ID NO: 734 - protein, 29 aa, synthetic construct
MYIPSSLKALLYLSLARIIDTLLIISYIS

SEQ ID NO: 735 - protein, 71 aa, synthetic construct
MNSIPVPTLTETSRSFIIIPLSVSITHCLTRDSFGIVRTISSNGITAHLVNSLYILCNMALLLPYTINLLL

SEQ ID NO: 736 - protein, 39 aa, synthetic construct
MILILISYSDIYIYVIMYNRNCLLHLYKIHDLLKYIYRY

SEQ ID NO: 737 - protein, 37 aa, synthetic construct
MFERDYNPVLYGMWKNWNTRVLYNEEINIHSSQVFPF

SEQ ID NO: 738 - protein, 31 aa, synthetic construct
MNLIIRFSVSTTKLGLNHFKRGRSYIHRVRH

SEQ ID NO: 739 - protein, 43 aa, synthetic construct
MVIDTFSFHRTRKSSGMGHHKSKYIPIVFWLWLSFLNQMVRSI

SEQ ID NO: 740 - protein, 35 aa, synthetic construct
MIFYIISNWFRSRDFEYRRAIKIIYILWFLRTSFW

SEQ ID NO: 741 - protein, 25 aa, synthetic construct
MSTMNPDRVCRLYNKCIRHQPVPHN

SEQ ID NO: 742 - protein, 33 aa, synthetic construct
MFFISCLKKLSRGYTVNVVAIASSPGNVVSISY

SEQ ID NO: 743 - protein, 59 aa, synthetic construct
MMFIHCVVFPDLSNPSKTINAPRDIFVNLTYFLQFMRIIKLKINIWSSETIRSTFIDHG

SEQ ID NO: 744 - protein, 346 aa, synthetic construct; identical to SEQ ID NO: 617

SEQ ID NO: 745 - protein, 219 aa, synthetic construct; identical to SEQ ID NO: 613

SEQ ID NO: 746 - protein, 277 aa, synthetic construct; identical to SEQ ID NO: 609

SEQ ID NO: 747 - protein, 38 aa, synthetic construct
MTPLKRERENENENKNILVTPSERGLIFFMRPSKRERE

SEQ ID NO: 748 - protein, 34 aa, synthetic construct
MMSFTTSALYMMFLFSNTKSNTVFSRKVDVVSDV

SEQ ID NO: 749 - protein, 55 aa, synthetic construct
MGNFEIKLSSVLMLSTMESILSLFFTVSVMMDVSSFLYHLMSDSLRISICGVCFV

SEQ ID NO: 750 - protein, 26 aa, synthetic construct
MLLAELILRCFYKVSRLRERVTVEQS

SEQ ID NO: 751 - protein, 53 aa, synthetic construct
MIARSSSAVFMESFLMKHLMISTQLSILSHGSESFNSPPKSSVASVLKEMRSL

SEQ ID NO: 752 - protein, 29 aa, synthetic construct
MLIEGFNFHFFNGLWMRNESDIILRYVVM

SEQ ID NO: 753 - protein, 25 aa, synthetic construct
MTFSHKWTYRCRSNEEKYYLYHLHN

SEQ ID NO: 754 - protein, 30 aa, synthetic construct
MIQILHSLDNSVTESYLLLVCLYHSILQTV

SEQ ID NO: 755 - protein, 31 aa, synthetic construct
MLQLNVMIQRSFSYACFITPRTCRSKIYSQR

SEQ ID NO: 756 - protein, 33 aa, synthetic construct
MDEVTNIRHAINPYIIILILLIITICLIFSLYY

SEQ ID NO: 757 - protein, 37 aa, synthetic construct
MLNFSLCLYPVFILNKLVLRTQSIILHTINNASIKNR

SEQ ID NO: 758 - protein, 27 aa, synthetic construct
MLYSAMKWCTSFKVTIDIESIQRSNNI

SEQ ID NO: 759 - protein, 41 aa, synthetic construct
MVVFVYIIYALLSYTVYAIIMFLPYIPPSYVRLSSIYYFIN

SEQ ID NO: 760 - protein, 39 aa, synthetic construct
MNMTESNISMSSLKTDITIVLSLVQNTIVRKNTCVDILH

SEQ ID NO: 761 - protein, 35 aa, synthetic construct
MLGIVNAIHVNVVASSSLTGLMFNRDVITRLLSVI

SEQ ID NO: 762 - protein, 38 aa, synthetic construct
MPSGNCIVEGIILSRTSNFTILVTLYVLPLYIYSKTHV

SEQ ID NO: 763 - protein, 75 aa, synthetic construct
MVIIPGVRCLSLLFLRRRCPLHIISAFTLLAINALILGHTISPVDLSFTICGYEIRSIFDSETDTIVKFNDIMSQ

SEQ ID NO: 764 - protein, 91 aa, synthetic construct
MYNSSIHTPEYDVIIHVIEHLKHHKQCVQTVTSGMVFTSPVSSSICTKSDDGRNLSDGFLLIRYITTDDFCTIFDIIPRHIFYQLANVDEH

SEQ ID NO: 765 - protein, 35 aa, synthetic construct
MEVCHRTILSCNIPTFLNLLVLKLLLQDDCLHTYN

SEQ ID NO: 766 - protein, 26 aa, synthetic construct
MLDVQIDMVVVFSQCYSRWSNFYFDA

SEQ ID NO: 767 - protein, 50 aa, synthetic construct
MGFHLPSIHVDDGDPVSIKPLLQLRCITPPIENVDPEINPLDRDGISHFC

SEQ ID NO: 768 - protein, 28 aa, synthetic construct
MYEAPITSYPTSQLIVIYSPNEYFSLTG

SEQ ID NO: 769 - protein, 49 aa, synthetic construct
MHNTKSFDMLFYIILYQSEVVVTHRESKYFVCIIINSNEQISTLCVGKR

SEQ ID NO: 770 - protein, 27 aa, synthetic construct
MNAYAHNSILYHSQYQNDHIQQTTYGV

SEQ ID NO: 771 - protein, 26 aa, synthetic construct
MLNFSIYSVSCFKYVMMNPYSFQTQV

SEQ ID NO: 772 - protein, 47 aa, synthetic construct
MKILVVPTESVCVKHRHDFGCTHEINNKLSYFLIFIDKNFTSTKHHT

SEQ ID NO: 773 - protein, 107 aa, synthetic construct
MVIYCSNSLGAYCKLVINKVAVLLTYFCFVALTNAQFFVSDILVHGKIPPNHLIIQYPSVSRSPRLDTTYPLCESIGVNSRVPLSILFGFLINGTCSPLDMNLETNP

SEQ ID NO: 774 - protein, 62 aa, synthetic construct
MVFKISIPINITDLFGNLLLLALITASRSAPNLLITKNRYSTLMDLYRPNALHVIRPTCFIL

SEQ ID NO: 775 - protein, 28 aa, synthetic construct
MIVAVYGNLIMRITYTDRYQLDAMVSRK

SEQ ID NO: 776 - protein, 107 aa, synthetic construct; identical to SEQ ID NO: 626

SEQ ID NO: 777 - protein, 46 aa, synthetic construct
MYFFNYYRKNNKYGIQPYIFLLSLTFYDISTYTSLFCSIDFILSSM

SEQ ID NO: 778 - protein, 48 aa, synthetic construct
MSGSYFPNILDPNSPTSGKFIIIQCLFISHDDPLSISSLSRILICGSK

SEQ ID NO: 779 - protein, 28 aa, synthetic construct
MSDEINSSQTSLSFPIDMITGITSLGLK

SEQ ID NO: 780 - protein, 36 aa, synthetic construct
MSRFFPRFILSYPSKSRKSNGYSICGMGLGRCKLCS

SEQ ID NO: 781 - protein, 66 aa, synthetic construct
MFVYKNNFRIQYDRRSFFKCFRYVFFEIIHFMREYWFHVSTKEGKLVIIFMNLYSFTIVFDFRKHS

SEQ ID NO: 782 - protein, 244 aa, synthetic construct; identical to SEQ ID NO: 620

SEQ ID NO: 783 - protein, 25 aa, synthetic construct
MSIPFMIYHQDMYTQKVNVWPSNWL

SEQ ID NO: 784 - protein, 42 aa, synthetic construct
MLHGCTCWLQNISSIRDLRLKEMLTFATITLHRVRTICLIFY

SEQ ID NO: 785 - protein, 29 aa, synthetic construct
MSLYLSFISLYHIIESYPIIVIHVDRCRE

SEQ ID NO: 786 - protein, 36 aa, synthetic construct
MRHDTFTEHCISLYFKFPDNETIKLGLSEPYLCFKK

SEQ ID NO: 787 - protein, 26 aa, synthetic construct
MSSRYNDRRYRGVPSKQLHSIRVLIH

SEQ ID NO: 788 - protein, 32 aa, synthetic construct
MPFSHCYLLYMFFNKTSIGINLTLAFYSYYKI

SEQ ID NO: 789 - protein, 34 aa, synthetic construct
MQFGSIRCTTNIFPFFSSILRGIFSYKIIWGCLV

SEQ ID NO: 790 - protein, 25 aa, synthetic construct
MHLLSFYLLMVYELIYVLQLLIVSL

SEQ ID NO: 791 - protein, 89 aa, synthetic construct
MKYILYSRCSFSFSFISNHLTPDGPSKIGWLDKGFIISSSTLYFSMTSNVVCGTTFPAGKHIPGAGDGNCFVYPSNFDVEKDCLMVFIE

SEQ ID NO: 792 - protein, 45 aa, synthetic construct
MINDPHTRNLLIHRNTNAHIYIINSTVQYLFLDRYRIVRLHFFVY

SEQ ID NO: 793 - protein, 45 aa, synthetic construct
MFCIYIISTVIISNKIANFRNAEYREYLHLYNVTAAIILNITSIL

SEQ ID NO: 794 - protein, 33 aa, synthetic construct
MILFLLIKIIIAMCSSKRIILTKFIVEFCNERI

SEQ ID NO: 795 - protein, 105 aa, synthetic construct
MAPSTEHIYDSVAGSTLLINNDRNEQTIYQNTTVVLNEDTKQNPNYSSNPFVNYNKTSICSKSNPFITELNNKFSENNPFRRAHSDDYLNKQEQDHEHDDIESLV

SEQ ID NO: 796 - protein, 263 aa, synthetic construct; identical to SEQ ID NO: 607

SEQ ID NO: 797 - protein, 25 aa, synthetic construct
MQSHRLRNSQTVVLSCFLHQKEEQF

SEQ ID NO: 798 - protein, 133 aa, synthetic construct; identical to SEQ ID NO: 614

SEQ ID NO: 799 - protein, 240 aa, synthetic construct; identical to SEQ ID NO: 619

SEQ ID NO: 800 - protein, 552 aa, synthetic construct; identical to SEQ ID NO: 623

SEQ ID NO: 801 - protein, 31 aa, synthetic construct
MRGVKFISRSHSSHECFLFYQRKCLVDYSPV

SEQ ID NO: 802 - protein, 98 aa, synthetic construct
MDIKNLLTACTIFYITTLATADIPTPPPTGHVTRENILIRGIINVVIGVHLENLPRLDVMVTITQNVNAAHLIHIPQSPIILMDVINVENAQPDHLIR

SEQ ID NO: 803 - protein, 59 aa, synthetic construct; identical to SEQ ID NO: 628

SEQ ID NO: 804 - protein, 564 aa, synthetic construct; identical to SEQ ID NO: 629

SEQ ID NO: 805 - protein, 37 aa, synthetic construct
MSGIVKSIILSGPSGSGKTAIAKRLWEYIWICGVPYH

SEQ ID NO: 806 - protein, 219 aa, synthetic construct; identical to SEQ ID NO: 633

SEQ ID NO: 807 - protein, 558 aa, synthetic construct; identical to SEQ ID NO: 635

SEQ ID NO: 808 - protein, 48 aa, synthetic construct
MLISTMPLEHFYSGTIITRDLLCMEEVTPYYIIYTGYLQDAPLYRSMI

SEQ ID NO: 809 - protein, 182 aa, synthetic construct; identical to SEQ ID NO: 638

SEQ ID NO: 810 - protein, 272 aa, synthetic construct; identical to SEQ ID NO: 639

SEQ ID NO: 811 - protein, 166 aa, synthetic construct; identical to SEQ ID NO: 642

SEQ ID NO: 812 - protein, 32 aa, synthetic construct
MARNGLSEILYILVIQYYIRSEKISLVRSTIT

SEQ ID NO: 813 - protein, 345 aa, synthetic construct; identical to SEQ ID NO: 644

SEQ ID NO: 814 - protein, 149 aa, synthetic construct; identical to SEQ ID NO: 645

SEQ ID NO: 815 - protein, 33 aa, synthetic construct
MYRQRAIFCIIHGVRKRASNLTMSSNKYAIIRI

SEQ ID NO: 816 - protein, 32 aa, synthetic construct
MTHFTIGTLRIAILKRIDTHFQNTCRLINTMV

SEQ ID NO: 817 - protein, 31 aa, synthetic construct
MRDTLMYIIKICTCQRYMINYFLFSQIKIVY

SEQ ID NO: 818 - protein, 318 aa, synthetic construct; identical to SEQ ID NO: 650

SEQ ID NO: 819 - protein, 51 aa, synthetic construct
MIYMLYATSKMKKMLRLVYLDITRIRITDGNWLRRQKADYQLCILFFMTIP

SEQ ID NO: 820 - protein, 43 aa, synthetic construct
MNRICYKIHLMCTLANGIICVINIRIVISCTIYYPSTKYNRIK

SEQ ID NO: 821 - protein, 51 aa, synthetic construct
MNLQKLSLAIYLTATCSWCYETCIRKTALYHDIQLEHVEDNKDSVASLPYK

SEQ ID NO: 822 - protein, 36 aa, synthetic construct
MIEVILFFITSASICPLMRKRHLIRCIVKRNLLKSW

SEQ ID NO: 823 - protein, 40 aa, synthetic construct
MKPKVNNIGNTPLHNYVSQYDITLIPHPQPIKKMEIKALY

SEQ ID NO: 824 - protein, 35 aa, synthetic construct
MRYIVTSSINAIQTLRLFDCYSLAESRDFVETTKD

SEQ ID NO: 825 - protein, 163 aa, synthetic construct
MAVNHVSNNGRLCMYGLILSRFNNCGYHCYETILIDVFDILSKYMDNIDMIDNENKTLLYYAVDVNNIQFAKRLLEYGASVTTSRSIINTAIQKSSYRRENKTRIVDLLLSYHPTLETMIDAFNRDIRYLYPEPLFACIRYALILDDDFPSKVSMISPVVIRN

SEQ ID NO: 826 - protein, 109 aa, synthetic construct; identical to SEQ ID NO: 456

SEQ ID NO: 827 - protein, 84 aa, synthetic construct
MYDDLKPVPRNTFNYIDVEINLYPVNDTSCTRTTTTGLSESISTSELTITMNHKDCNPVFRDGYFSVLNKVATSGFFTGERCAL

SEQ ID NO: 828 - protein, 136 aa, synthetic construct
MHVPASLQQSSSSCTEEENKHHMGIDVIIKVTKQDQTPTDDKICQSVTEITESESDPDPEVESVEDVDPPTTYYSIIGGGLRMNFGFTKCPQIKSISESADGKTVRCLSTSDVAKKRKTATSRPIQYSGLTSLIRK

SEQ ID NO: 829 - protein, 33 aa, synthetic construct
MSTDRHLKVQPMILHSSIQQNSKRVSESITLFI

SEQ ID NO: 830 - protein, 40 aa, synthetic construct
MSRVNRTIQAHHELKKCTGHYIPVCKTKSYLSRLLLFLSQ

SEQ ID NO: 831 - protein, 222 aa, synthetic construct
MVSLKYFYSHSLFNGVIKYFYSLSLFDGLTKILNLFLMVSLKYFYSHSLFNGVIKYFYSLSLFDGLIKKVLQKYFYSLSLFDGLIKKVLQKYFYSLSLFDGLIKKFYKNIFILFLSLMVSQKYFYSLSLFDGLIKKVLQKYFYSLSLFDGLIKNIKPLSDGVTKIFLFSFSLQWSHKIFLFSFSLRWSHKNIKPLSDGVTKIFLFSFSLQWSHKIFLFSFSL

SEQ ID NO: 832 - protein, 29 aa, synthetic construct
MTMRCTILFLIDYRRLYSVLVLSEDVLSL

SEQ ID NO: 833 - protein, 50 aa, synthetic construct
MVIQFPSNILCRIIYSTRNNDGIITCCILYGLCSCYNNQRIEVYQRYSNS

SEQ ID NO: 834 - protein, 210 aa, synthetic construct; identical to SEQ ID NO: 611

SEQ ID NO: 835 - protein, 36 aa, synthetic construct
MPRRMELKNGNIFVVQRILPNCIRVTLYNNYTTFLS

SEQ ID NO: 836 - protein, 25 aa, synthetic construct
MLFNVSALIVYFDVCSHIVYAIVRL

SEQ ID NO: 837 - protein, 38 aa, synthetic construct
MGHRIYRFRSPWIQTSKLRVYGIAISVYTNCMKIKKTV

SEQ ID NO: 838 - protein, 26 aa, synthetic construct
MCIERVEITLPVYAQLVIKIKSNIHM

SEQ ID NO: 839 - protein, 194 aa, synthetic construct; identical to SEQ ID NO: 615

SEQ ID NO: 840 - protein, 37 aa, synthetic construct
MHRVIIDCTIHNVTVLLTLLVKDFRQFVSFSVNSSGS

SEQ ID NO: 841 - protein, 28 aa, synthetic construct
MLMADEWITVFIGSYCFHATSIDQILDS

SEQ ID NO: 842 - protein, 29 aa, synthetic construct
MYNFFYSVKDMIKNIIVVFIPFQSPYMIL

SEQ ID NO: 843 - protein, 62 aa, synthetic construct
MIYSNAFMWAYNKSLLMEYSKSFSCLVFNKRRDFNRLFMNSNAASLSLILMMSNSPNIITDE

SEQ ID NO: 844 - protein, 26 aa, synthetic construct
MNGFIIIVFMLDMSLVRLSTSIDDDF

SEQ ID NO: 845 - protein, 53 aa, synthetic construct
MVARDFSLKDDVAQDPLLNESILSLDKMDSLFSLDGLIFLLPMIYKGRPNRLG

SEQ ID NO: 846 - protein, 162 aa, synthetic construct; identical to SEQ ID NO: 622

SEQ ID NO: 847 - protein, 334 aa, synthetic construct; identical to SEQ ID NO: 624

SEQ ID NO: 848 - protein, 190 aa, synthetic construct; identical to SEQ ID NO: 625

SEQ ID NO: 849 - protein, 30 aa, synthetic construct
MMFELIHLKHTIKKKIVGHWIMVTCYHAII

SEQ ID NO: 850 - protein, 315 aa, synthetic construct; identical to SEQ ID NO: 630

SEQ ID NO: 851 - protein, 151 aa, synthetic construct; identical to SEQ ID NO: 631

SEQ ID NO: 852 - protein, 300 aa, synthetic construct; identical to SEQ ID NO: 632

SEQ ID NO: 853 - protein, 29 aa, synthetic construct
MPFLEYHRLLPMMSGNILLCQFIITSMTL

SEQ ID NO: 854 - protein, 30 aa, synthetic construct
MNIYKLEIRSMIKKEIKSLSSHIATKTTML

SEQ ID NO: 855 - protein, 25 aa, synthetic construct
MIQKIFLLLYRRHHRGNHLSRRPRE

SEQ ID NO: 856 - protein, 46 aa, synthetic construct
MRLPRHTCALSKWKDAVVLCLQIGQNHGIWILMVSRSILQMNGCHI

SEQ ID NO: 857 - protein, 27 aa, synthetic construct
MLQNINYIWIFLKRKYLTGVYIYLFII

SEQ ID NO: 858 - protein, 28 aa, synthetic construct
MQKTVTVVHYYIDVYITIRNQNQNHTMN

SEQ ID NO: 859 - protein, 317 aa, synthetic construct; identical to SEQ ID NO: 636

SEQ ID NO: 860 - protein, 28 aa, synthetic construct
MISTLIFTNMMVMSNNILLLQRENAIKE

SEQ ID NO: 861 - protein, 27 aa, synthetic construct
MDIVIHIIQNMIFKNLKYIITSVTVVK

SEQ ID NO: 862 - protein, 62 aa, synthetic construct
MVYTIYPLKIMASRRGKQCIQMYQKEHTTYPHFQRMISYLSGLNLNKAIIKWKSIVRDYASK

SEQ ID NO: 863 - protein, 52 aa, synthetic construct
MLLEVAKRFLFTNAVTCVISTCCIRLTSHSEILKNQYHMISMTTIARLQVAA

SEQ ID NO: 864 - protein, 43 aa, synthetic construct
MIQKRNKTAYYTLVNALIGSNHFQDEVPDYSPSVPLYHLLHVY

SEQ ID NO: 865 - protein, 28 aa, synthetic construct
MRHYDKHVRVYTLSRIYPWKNRTEEYTD

SEQ ID NO: 866 - protein, 29 aa, synthetic construct
MSMKSIQKQLQQLVHWCQTVHQQLQMSSV

SEQ ID NO: 867 - protein, 33 aa, synthetic construct
MHTATGNALDSCIPHSSLLEMMRNQCSSTFASW

SEQ ID NO: 868 - protein, 48 aa, synthetic construct
MMSKIVQKSSVVIYRMSKKPSERFRPSSDFVHMLLLTGEVKTIPLVTV

SEQ ID NO: 869 - protein, 326 aa, synthetic construct; identical to SEQ ID NO: 646

SEQ ID NO: 870 - protein, 27 aa, synthetic construct
MRTFTTKHHKNESSSDLCFKYQPQINS

SEQ ID NO: 871 - protein, 25 aa, synthetic construct
MSRRNNVTQTVHCSRHYTICSFKMP

SEQ ID NO: 872 - protein, 351 aa, synthetic construct; identical to SEQ ID NO: 649

SEQ ID NO: 873 - protein, 53 aa, synthetic construct
MNSESDNISIKTEYEFYDETQDQSTQLVGYDIKLKTNEDDFMAMIDQWVSMII

SEQ ID NO: 874 - protein, 30 aa, synthetic construct
MDSISMVTLKDVHHFIALYNITSLRLLSTY

SEQ ID NO: 875 - protein, 37 aa, synthetic construct
MLALLMVCNMIDCVRNTNLLSMNTGYKHKLKFNIIYL

SEQ ID NO: 876 - protein, 190 aa, synthetic construct; identical to SEQ ID NO: 653

SEQ ID NO: 877 - protein, 36 aa, synthetic construct
MIHVLKYFPNKSFKYCINYEKLCYASMMQRCLMIRY

SEQ ID NO: 878 - protein, 181 aa, synthetic construct; identical to SEQ ID NO: 454

SEQ ID NO: 879 - protein, 34 aa, synthetic construct
MRIKLYYITRSMSIIYNLQSGYWNMERVLQHHAR

SEQ ID NO: 880 - protein, 29 aa, synthetic construct
MTYYKIDSVQDDKNIYRHHKHGVYFICLA

SEQ ID NO: 881 - protein, 223 aa, synthetic construct
MDEIVRIVRDSMWYIPNVFMDDGKNEGHVSVNNVCHMYFTFFDVDTSSHLFKLVIKHCDLNKRGNSPLHCYTMNTRFNPSVLKILLHHGMRNFDSKDEKGHIPLHHYLIHSLSIDNKIFDILTDTIDDFSKSSDLLLCYLRYKFNGSLNYYVLYKGSDPNCVDEDGLTSLHYYCKHISTFYKSNYYKLSHTKMRAEKRFIYAIIDYGANINAVTHLPSTVYQT

SEQ ID NO: 882 - protein, 64 aa, synthetic construct
MLPHTSDTTSTFRLKTVFDLVFENRNIIYKADVVNDIIHHRLKVSLPMIKSLFYKMSLPTTITT

SEQ ID NO: 883 - protein, 30 aa, synthetic construct
MWKLICIPSTTHRVLGRPLPVSANPSQRRN

SEQ ID NO: 884 - protein, 54 aa, synthetic construct
MKQYIVLACMCLPVFSNHPHRVRKKKTNIIWESMLLSKSQSKTKHRPMIRFANP

SEQ ID NO: 885 - protein, 76 aa, synthetic construct
MVSLKYFYSLSLFNGVIKYFYSLSLFDGLTKILNLFLMVSLKYFYSLSLFNGVIKYFYSLSLFDGLTKIFLFSFSL

SEQ ID NO: 886 - protein, 318 aa, synthetic construct
MVSLKYFYSHSLFNGVIKYFYSLSLFDGLTKILNLFLMVSLKYFYSHSLFNGVIKYFYSLSLFDGLIKKVLQKYFYSLSLFDGLIKKVLQKYFYSLSLFDGLIKKVLQKYFYSLSLFDGLIKKVLQKYFYSLSLFDGLIKKVLQKYFYSLSLFDGLIKNIKPLSDGVTKIFLFSFSFSLSLFNGVIKYFYSLSLFDGLTKILNLFLMVSLKYFYSHSLFNGVIKYFYSLSLFDGLIKKVLQKYFYSLSLFDGLIKKVLQKYFYSLSLFDGLIKKVLQKYFYSLSLFDGLIKKVLQKYFYSLSLFDGLTKILNLFLMES

SEQ ID NO: 887 - protein, 57 aa, synthetic construct; identical to SEQ ID NO: 608

SEQ ID NO: 888 - protein, 43 aa, synthetic construct
MRCTAHDNLHSNQNENTLVIIRNIDGNVIINNPIICRRVNIDG

SEQ ID NO: 889 - protein, 83 aa, synthetic construct; identical to SEQ ID NO: 610

SEQ ID NO: 890 - protein, 35 aa, synthetic construct
MVYEEHSSIKMVLMTKFTFFSLILSAQRELSKFRI

SEQ ID NO: 891 - protein, 81 aa, synthetic construct; identical to SEQ ID NO: 612

SEQ ID NO: 892 - protein, 35 aa, synthetic construct
MLPTSEGGTVLKSLGFNLLPLVFMKSFVLSTSHFK

SEQ ID NO: 893 - protein, 45 aa, synthetic construct
MSTIHSSVNFTRSSWVIEFIGSVVHGSKLANFAYTVSRLVYTPTV

SEQ ID NO: 894 - protein, 78 aa, synthetic construct; identical to SEQ ID NO: 616

SEQ ID NO: 895 - protein, 28 aa, synthetic construct
MITELLAFITSCSAIRLLFAYTCPGDIS

SEQ ID NO: 896 - protein, 125 aa, synthetic construct; identical to SEQ ID NO: 618

SEQ ID NO: 897 - protein, 204 aa, synthetic construct; identical to SEQ ID NO: 621

SEQ ID NO: 898 - protein, 36 aa, synthetic construct
MLVQCYKWMKHITLATWNQYSDTCPICIPNSHQYLN

SEQ ID NO: 899 - protein, 28 aa, synthetic construct
MVKNKARLFERGFHGRFCRFSSTRCLLW

SEQ ID NO: 900 - protein, 25 aa, synthetic construct
MTMTRLLLVYIIILNLKMLFLLSYL

SEQ ID NO: 901 - protein, 27 aa, synthetic construct
MSVDAVILNHRLGFLIEMRCSMDHRVI

SEQ ID NO: 902 - protein, 29 aa, synthetic construct
MKKEKNIYLSKKKKLLMLSNLIILSTMTC

SEQ ID NO: 903 - protein, 30 aa, synthetic construct
MFGEMRNCFLDGNIVYERLNCLLMITCLIR

SEQ ID NO: 904 - protein, 27 aa, synthetic construct
MWKCHRKLMRAKIYKVVFHICYFFCNS

SEQ ID NO: 905 - protein, 132 aa, synthetic construct; identical to SEQ ID NO: 627

SEQ ID NO: 906 - protein, 37 aa, synthetic construct
MGIYLDLWCPIPLDFLVLWNEKVSITITLTERPSGRE

SEQ ID NO: 907 - protein, 124 aa, synthetic construct; identical to SEQ ID NO: 634

SEQ ID NO: 908 - protein, 54 aa, synthetic construct
MINRKLHLHVIRDIILWIQMLSAKQINGNTKIHARKCAQFLIMSLNYMISHYTK

SEQ ID NO: 909 - protein, 33 aa, synthetic construct
MTNISSINCYRKYKSVKIINNLITNKYQKIKDL

SEQ ID NO: 910 - protein, 173 aa, synthetic construct; identical to SEQ ID NO: 637

SEQ ID NO: 911 - protein, 77 aa, synthetic construct; identical to SEQ ID NO: 641

SEQ ID NO: 912 - protein, 72 aa, synthetic construct
MDTDVTNVEDIINEIDREKEEILKNVEIENNKNINKNHPSGYIREALVINTSSNSDSIDKEVIECISHDVGI

SEQ ID NO: 913 - protein, 283 aa, synthetic construct; identical to SEQ ID NO: 643

SEQ ID NO: 914 - protein, 42 aa, synthetic construct
MGISMSSLVYCEQQEQISIGKGGMRYIDLCSFKTHANFEEFI

SEQ ID NO: 915 - protein, 27 aa, synthetic construct
MNSSRYCSLSYSYTCINFLDILQSVLF

SEQ ID NO: 916 - protein, 574 aa, synthetic construct; identical to SEQ ID NO: 648

SEQ ID NO: 917 - protein, 45 aa, synthetic construct
MSTFIIIDQSTENTSIDTTVTINIIYLAIMKIIMNIIMMIMIELV

SEQ ID NO: 918 - protein, 134 aa, synthetic construct; identical to SEQ ID NO: 651

SEQ ID NO: 919 - protein, 357 aa, synthetic construct; identical to SEQ ID NO: 652

SEQ ID NO: 920 - protein, 91 aa, synthetic construct; identical to SEQ ID NO: 453

SEQ ID NO: 921 - protein, 30 aa, synthetic construct
MSTYEKTSFNKMHREKKFIKELVKYETESK

SEQ ID NO: 922 - protein, 385 aa, synthetic construct
MIAFIIFREIGIISTRIAMDCTCILCRLLDEDVTYKKIKLEIETCHNLSKHIDRRGNNALHCYVFNKCDTDIKIVRLLLSRGVERLCRNNEGLTPLGAYSKHRYVKSQIVHLLISSYSNSSNELKSNINDFDLYSYMSSDNIDLRLLKYLIVDKRIRPSKNTNYAINGLGLVDIYVTTPNPRPEVLLWLLKSECYSTGYVFRTCMYDSDMCKNSLHYYISSHRESQSLSKDVIKCLINNNVSIHGRDEGGSLPIQYYWSCSTIDIEIVKLLIKDVDTCRVYDVSPILEADYLNKRFRVTPYNVDMEIVNLLIERRHTLVDVMRSITSYDSRDYNHYIIDNILKRFRQQDESIVQAMLINYLHYGDMVVRCMLDNGQQLSSARLLC

SEQ ID NO: 923 - protein, 38 aa, synthetic construct
MKNAYISGVSMFDILFKRSKRHRLRYAKNPTSNGTKKN

SEQ ID NO: 924 - protein, 54 aa, synthetic construct
MRWTRLYASFATVCGTYLTYLWTTVRMKVTFLSTMFVICILRSLMWIHRLICLS

SEQ ID NO: 925 - protein, 77 aa, synthetic construct
MEQTLTRLHTYLQQYTKHSPRVVYALLSRGADTRIRNNLDCTPIMERLCNRSYSHNVTQLARTKGRRTTSTLSIHKT

SEQ ID NO: 926 - protein, 36 aa, synthetic construct
MPHSETVTLASTSIYYIVIPILKTTKLIQSLIMWVM

SEQ ID NO: 927 - protein, 37 aa, synthetic construct
MCKESSELEVKYVDGSASEGATDDTSLIDSTKLKACV

SEQ ID NO: 928 - protein, 177 aa, synthetic construct
MVSQKYFYSLSLFDGLIKKVLQKYFYSLSLFDGLIKKVLQKYFYSLSLFDGLIKKVLQKYFYSLSLFDGLIKKVLQKYFYSLSLFDGLIKKVLQKYFYSLSLFDGLIKNIKPLSDGVTKIFLFSFSLQWSHKIFLFSFSLRWSHKNIKPLSDGVTKIFLFSFSLQWSHKIFLFSFSL

SEQ ID NO: 929 - DNA, 52 bp, synthetic construct
  source 1..52: mol_type = other DNA
gcggtcgaccaccatgccacctcctcgcctcctcttcttcctcctcttcctc

SEQ ID NO: 930 - DNA, 63 bp, synthetic construct
  source 1..63: mol_type = other DNA
gcgggatccataaaaattaattaatcatcttttcctcctcaggaccagggctctttgaagatg

SEQ ID NO: 931 - protein, 498 aa, synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 932 - protein, 504 aa, synthetic construct
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 933 - protein, 525 aa, synthetic construct
MDMRVPAQLLGLLLLWLRGARCDIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 934 - protein, 1013 aa, synthetic construct
MDMRVPAQLLGLLLLWLRGARCDIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 935 - protein, 39 aa, synthetic construct
GSGGGGSQVQLQQSGAELVRPGSSVKISCKASGYAFSSY

The invention claimed is:

1. A method of treating a subject having a solid tumor comprising:

administering to the subject an effective amount of an oncolytic virus expressing a truncated CD19 (OV19t), the nucleotide sequence of the OV19t comprising:

(a) a nucleotide sequence that is at least 99% identical to nucleotides 5,014-178,073 of SEQ ID NO: 1 over the entire length of nucleotides 5,014-178,073 of SEQ ID NO: 1; and (b) encodes a truncated human CD19 (CD19t) comprising the amino acid sequence of SEQ ID NO:4; and administering to the subject an effective amount of a bispecific T cell engager (TCE) that binds to CD19t and comprises:

(i) a CD19-targeted scFv comprising a variable heavy (VH) chain selected from SEQ ID NOs: 73, 81, and 89 and a variable light (VL) chain selected from SEQ ID NOs: 69, 77, and 85; and (ii) a CD3-targeted scFv comprising a VH selected from SEQ ID NOs: 97, 113, 122, 103, and a VH comprising complementarity determining regions 1-3 (CDR1-CDR3) comprising SEQ ID NOs: 102-104, respectively, and a VL selected from SEQ ID NOs: 93, 109, 118, 126, and a VL comprising CDR1-CDR3 comprising SEQ ID NOs: 98-100, respectively.

2. The method of claim 1, wherein the nucleotide sequence of the OV19t is 99.5% identical to nucleotides 5,014-178,073 of SEQ ID NO: 1 over the entire length of nucleotides 5,014-178,073 of SEQ ID NO: 1.

3. The method of claim 1, wherein the nucleotide sequence of the OV19t is 99.9% identical to nucleotides 5,014-178,073 of SEQ ID NO: 1 over the entire length of nucleotides 5,014-178,073 of SEQ ID NO: 1.

4. The method of claim 1, wherein the nucleotide sequence of the OV19t is identical to nucleotides 5,014-178,073 of SEQ ID NO: 1 over the entire length of nucleotides 5,014-178,073 of SEQ ID NO: 1.

5. The method of claim 1, wherein the nucleotide sequence of the OV19t encodes SEQ ID NOs: 654, 670, 679, 680, 681, 685, 687, 689, 694, 705, 706, 708, 716, 718, 719, 729, 730, 732, 734, 735, 740, 743, 744, 745, 746, 757, 761, 763, 764, 769, 771, 773, 776, 781, 782, 783, 791, 793, 795, 796, 798, 799, 800, 802, 803, 804, 805, 806, 807, 808, 809, 810, 811, 813, 814, 818, 821, 822, 823, 825, 826, 827, 828, 829, 830, 831, 834, 835, 839, 845, 846, 847, 848, 850, 851, 852, 856, 859, 864, 865, 869, 872, 873, 875, 876, 877, 878, 879, 880, 881, 882, 884, 885, 886, 887, 889, 891, 893, 894, 896, 897, 905, 906, 907, 910, 911, 912, 913, 914, 916, 917, 918, 919, 920, 921, 922, 923, 924, 925, 927, and 928.

6. The method of claim 1, wherein the OV19t comprises a nucleotide sequence having no more than 100 single nucleotide changes compared to nucleotides 5,014-178,073 of SEQ ID NO: 1.

7. The method of claim 1, wherein the OV19t comprises a nucleotide sequence having no more than 50 single nucleotide changes compared to nucleotides 5,014-178,073 of SEQ ID NO: 1.

8. The method of claim 1, wherein the CD19t lacks a functional signaling domain.

9. The method of claim 1, wherein the TCE comprises an amino acid sequence selected from SEQ ID NOs: 931-934.

10. The method of claim 1, wherein the CD19-targeted scFv comprises a VH comprising SEQ ID NO: 73 and a VL comprising SEQ ID NO: 69.

11. The method of claim 1, wherein the CD19-targeted scFv comprises a VH comprising SEQ ID NO: 73 and a VL comprising SEQ ID NO: 77.

12. The method of claim 1, wherein the CD19-targeted scFv comprises a VH comprising SEQ ID NO: 89 and a VL comprising SEQ ID NO: 85.

13. The method of claim 1, wherein the CD3-targeted scFv comprises a VH comprising SEQ ID NO: 97 and a VL comprising SEQ ID NO: 93.

14. The method of claim 1, wherein the CD3-targeted scFv comprises:

a VH comprising a CDR1 comprising SEQ ID NO: 102, a CDR2 comprising SEQ ID NO: 103, and a CDR3 comprising SEQ ID NO: 104; and a VL comprising a CDR1 comprising SEQ ID NO: 98, a CDR2 comprising SEQ ID NO: 99, and a CDR3 comprising SEQ ID NO: 100.

15. The method of claim 1, wherein the CD3-targeted scFv comprises a VH comprising SEQ ID NO: 113 and a VL comprising SEQ ID NO: 109.

16. The method of claim 1, wherein the solid tumor is colon cancer or rectal cancer.

17. The method of claim 1, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

18. The method of claim 2, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

19. The method of claim 3, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

20. The method of claim 4, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

21. The method of claim 5, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

22. The method of claim 6, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

23. The method of claim 7, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

24. The method of claim 16, wherein the CD19 scFv comprises a VH comprising SEQ ID NO: 73 and a VL comprising SEQ ID NO: 69; and wherein the CD3-targeted scFv comprises a VH comprising SEQ ID NO: 97 and a VL comprising SEQ ID NO: 93.

25. The method of claim 2, wherein the TCE comprises an amino acid sequence selected from SEQ ID NOs: 931-934.

26. The method of claim 3, wherein the TCE comprises an amino acid sequence selected from SEQ ID NOs: 931-934.

27. The method of claim 4, wherein the TCE comprises an amino acid sequence selected from SEQ ID NOs: 931-934.

28. The method of claim 5, wherein the TCE comprises an amino acid sequence selected from SEQ ID NOs: 931-934.

29. The method of claim 6, wherein the TCE comprises an amino acid sequence selected from SEQ ID NOs: 931-934.

30. The method of claim 7, wherein the TCE comprises an amino acid sequence selected from SEQ ID NOs: 931-934.

31. The method of claim 16, wherein the TCE comprises an amino acid sequence selected from SEQ ID NOs: 931-934.

* * * * *